(12) United States Patent
Colosi et al.

(10) Patent No.: US 11,584,780 B2
(45) Date of Patent: Feb. 21, 2023

(54) ADENO-ASSOCIATED VIRUS CAPSID PROTEINS

(71) Applicant: BIOMARIN PHARMACEUTICAL INC., Novato, CA (US)

(72) Inventors: Peter Cameron Colosi, Novato, CA (US); Michael Lochrie, Novato, CA (US); Robert Ng, Novato, CA (US)

(73) Assignee: BIOMARIN PHARMACEUTICAL INC., Novato, CA (US)

( * ) Notice: Subject to any disclaimer, the term of this patent is extended or adjusted under 35 U.S.C. 154(b) by 306 days.

(21) Appl. No.: 16/319,877

(22) PCT Filed: Jul. 25, 2017

(86) PCT No.: PCT/US2017/043703
§ 371 (c)(1),
(2) Date: Jan. 23, 2019

(87) PCT Pub. No.: WO2018/022608
PCT Pub. Date: Feb. 1, 2018

(65) Prior Publication Data
US 2022/0402974 A1 Dec. 22, 2022

Related U.S. Application Data

(60) Provisional application No. 62/366,838, filed on Jul. 26, 2016.

(51) Int. Cl.
*C07K 14/005* (2006.01)
*C12N 15/86* (2006.01)
*A61K 48/00* (2006.01)
*A61K 38/00* (2006.01)

(52) U.S. Cl.
CPC ............ *C07K 14/005* (2013.01); *C12N 15/86* (2013.01); *A61K 38/00* (2013.01); *A61K 48/00* (2013.01); *C12N 2750/14122* (2013.01); *C12N 2750/14143* (2013.01); *C12N 2750/14152* (2013.01)

(58) Field of Classification Search
CPC .................. C07K 14/005; C12N 15/86; C12N 2750/14122
See application file for complete search history.

(56) References Cited

U.S. PATENT DOCUMENTS

| | | | |
|---|---|---|---|
| 4,745,051 A | 5/1988 | Smith et al. |
| 4,994,371 A | 2/1991 | Davie et al. |
| 6,204,059 B1 | 3/2001 | Samulski et al. |
| 6,531,298 B2 | 3/2003 | Stafford et al. |
| 7,198,951 B2 | 4/2007 | Gao et al. |
| 7,323,324 B2 | 1/2008 | Narimatsu et al. |
| 7,531,341 B1 | 5/2009 | Vellard et al. |
| 7,534,595 B2 | 5/2009 | Vellard et al. |
| 7,537,923 B2 | 5/2009 | Kakkis et al. |
| 7,560,263 B2 | 7/2009 | Kakkis et al. |
| 7,566,462 B2 | 7/2009 | Jungles et al. |
| 7,732,599 B2 | 6/2010 | Moser et al. |
| 7,790,433 B2 | 9/2010 | Kakkis et al. |
| 7,906,111 B2 | 3/2011 | Wilson et al. |
| 8,003,126 B2 | 8/2011 | Jungles et al. |
| 8,178,670 B2 | 5/2012 | Henderson et al. |
| 9,249,405 B2 | 2/2016 | Simioni |
| 9,393,323 B2 | 7/2016 | Nathwani et al. |
| 9,447,168 B2 | 9/2016 | Nathwani et al. |
| 9,504,762 B2 | 11/2016 | Colosi et al. |
| 9,557,340 B2 | 1/2017 | Foehr et al. |
| 9,695,220 B2 | 7/2017 | Vandenberghe et al. |
| 10,610,606 B2 | 4/2020 | Seymour et al. |
| 2002/0031799 A1 | 3/2002 | Stafford et al. |
| 2003/0138772 A1 | 7/2003 | Gao et al. |
| 2003/0148506 A1 | 8/2003 | Kotin et al. |
| 2003/0166284 A1 | 9/2003 | Srivastava et al. |
| 2004/0142416 A1 | 7/2004 | Laipis et al. |
| 2008/0249052 A1 | 10/2008 | Duan et al. |
| 2010/0129405 A1 | 5/2010 | Schmidt et al. |
| 2010/0216709 A1 | 8/2010 | Scheule et al. |
| 2011/0201088 A1 | 8/2011 | Beall et al. |
| 2011/0244550 A1 | 10/2011 | Simioni |
| 2013/0045186 A1 | 2/2013 | Gao et al. |
| 2015/0071883 A1 | 3/2015 | Colosi |

(Continued)

FOREIGN PATENT DOCUMENTS

| CN | 104293835 A | 1/2015 |
|---|---|---|
| CN | 105247044 A | 1/2016 |

(Continued)

OTHER PUBLICATIONS

Mochizuki et al. (2004) "Adeno-associated virus (AAV) vector-mediated liver- and muscle-directed transgene expression using various kinds of promoters and serotypes" Gene Ther Mol Biol vol. 8, 9-18. (Year: 2004).*

Govindasamy et al. (2013) "Structural Insights into Adeno-Associated Virus Serotype 5" Journal of Virology, vol. 87, No. 20, p. 11187-11199. (Year: 2013).*

Akinc et al., 2005, "Exploring polyethylenimine-mediated DNA transfection and the proton sponge hypothesis," J. Gene Med., 7(5):657-663.

Batts et al., 1995, "Chronic hepatitis. An update on terminology and reporting," Am. J. Surg. Pathol., 19(12):1409-1417.

(Continued)

*Primary Examiner* — James D Schultz
*Assistant Examiner* — James Joseph Graber
(74) *Attorney, Agent, or Firm* — Jones Day

(57) ABSTRACT

The invention relates to novel adeno-associated virus (AAV) capsid proteins, AAV particles comprising a novel capsid protein, polynucleotides encoding these capsid proteins and AAV vectors expressing these capsid proteins. The invention also relates to methods of making the herein described AAV vectors expressing the novel capsid proteins of the invention and associated therapeutic uses of thereof.

37 Claims, No Drawings
Specification includes a Sequence Listing.

(56) References Cited

U.S. PATENT DOCUMENTS

| | | |
|---|---|---|
| 2015/0110858 A1 | 4/2015 | DeRosa et al. |
| 2015/0158930 A1 | 6/2015 | Nathwani et al. |
| 2016/0215024 A1* | 7/2016 | Vandenberghe et al. ............. C07K 14/005 |
| 2017/0119906 A1 | 5/2017 | Riley |
| 2017/0216408 A1 | 8/2017 | Anguela et al. |
| 2019/0231901 A1 | 8/2019 | Seymour et al. |
| 2019/0376081 A1 | 12/2019 | Berguig et al. |
| 2020/0024579 A1 | 1/2020 | Colosi et al. |
| 2020/0069819 A1 | 3/2020 | Colosi et al. |
| 2020/0362368 A1 | 11/2020 | Colosi et al. |

FOREIGN PATENT DOCUMENTS

| | | |
|---|---|---|
| CN | 105579465 A | 5/2016 |
| EP | 127839 A2 | 12/1984 |
| EP | 127839 A3 | 12/1984 |
| EP | 155476 A1 | 9/1985 |
| EP | 127839 | 7/1992 |
| JP | 2003235562 A | 8/2003 |
| JP | 2007507223 A | 3/2007 |
| KR | 10-2010-0065284 A | 6/2010 |
| RU | 2273645 C9 | 5/1999 |
| RU | 2228202 C2 | 5/2004 |
| RU | 2273645 C2 | 11/2006 |
| RU | 2502800 C2 | 12/2013 |
| RU | 2015144234 A | 4/2017 |
| RU | 2653444 C2 | 5/2018 |
| WO | WO 1996005309 A2 | 2/1996 |
| WO | WO 1996005309 A3 | 2/1996 |
| WO | WO-98/10088 A1 | 3/1998 |
| WO | WO 1999054440 A1 | 10/1999 |
| WO | WO 2001083692 A2 | 11/2001 |
| WO | WO 2001083692 A3 | 11/2001 |
| WO | WO 2003042397 A2 | 5/2003 |
| WO | WO 2003042397 A3 | 5/2003 |
| WO | WO 2003074714 A1 | 9/2003 |
| WO | WO 2003087383 A1 | 10/2003 |
| WO | WO 2005033321 A2 | 4/2005 |
| WO | WO 2005033321 A3 | 4/2005 |
| WO | WO 2006073496 A2 | 7/2006 |
| WO | WO 2006073496 A3 | 7/2006 |
| WO | WO 2006110689 A2 | 10/2006 |
| WO | WO 2006110689 A3 | 10/2006 |
| WO | WO-2006/119432 A2 | 11/2006 |
| WO | WO 2009091912 A2 | 7/2009 |
| WO | WO 2009091912 A3 | 7/2009 |
| WO | WO-2010/127097 A1 | 11/2010 |
| WO | WO 2011119773 A1 | 9/2011 |
| WO | WO 2011005968 A1 | 10/2011 |
| WO | WO 2011126808 A2 | 10/2011 |
| WO | WO 2011126808 A3 | 10/2011 |
| WO | WO 2011126808 A9 | 10/2011 |
| WO | WO 2013004943 A1 | 1/2013 |
| WO | WO 2013123503 A1 | 8/2013 |
| WO | WO 2013186563 A2 | 12/2013 |
| WO | WO 2013186563 A3 | 12/2013 |
| WO | WO 2014151341 A1 | 9/2014 |
| WO | WO 2014194132 A1 | 12/2014 |
| WO | WO 2015013313 A2 | 1/2015 |
| WO | WO 2015013313 A3 | 1/2015 |
| WO | WO 2015038625 A1 | 3/2015 |
| WO | WO 2015054653 A2 | 4/2015 |
| WO | WO 2015054653 A3 | 4/2015 |
| WO | WO 2015138348 A1 | 9/2015 |
| WO | WO 2015138357 A2 | 9/2015 |
| WO | WO 2015138357 A3 | 9/2015 |
| WO | WO-2015/197869 A1 | 12/2015 |
| WO | WO 2016004318 A1 | 1/2016 |
| WO | WO 2016016119 A1 | 2/2016 |
| WO | WO-2016/049230 A1 | 3/2016 |
| WO | WO-2016/177911 A1 | 11/2016 |
| WO | WO-2017/019994 A2 | 2/2017 |
| WO | WO 2017053677 A1 | 3/2017 |
| WO | WO-2017/066764 A2 | 4/2017 |
| WO | WO 2018126112 A1 | 7/2018 |
| WO | WO 2018128689 A1 | 7/2018 |
| WO | WO 2019152841 A1 | 8/2019 |
| WO | WO 2019217513 A2 | 11/2019 |
| WO | WO 2019217513 A3 | 11/2019 |
| WO | WO 2019222132 A1 | 11/2019 |
| WO | WO 2019222136 A2 | 11/2019 |
| WO | WO 2019222136 A3 | 11/2019 |
| WO | WO 2019222136 A9 | 11/2019 |
| WO | WO 2020023612 A1 | 1/2020 |
| WO | WO 2020214929 A1 | 10/2020 |
| WO | WO 2020232044 A1 | 11/2020 |
| WO | WO 2021202943 A1 | 10/2021 |

OTHER PUBLICATIONS

Bedossa et al., 1996, "An algorithm for the grading of activity in chronic hepatitis C. The METAVIR Cooperative Study Group," Hepatology, 24(2):289-293.

Berry et al., 2016, "Chemical Modulation of Endocytic Sorting Augments Adeno-associated Viral Transduction," J. Biol. Chem., 291(2):939-947 (Epub 2015).

Berry et al., 2016, "Modulation of intracellular calcium enhances AAV transduction in the CNS," Mol. Ther., 24 (Suppl 1): S14 (Abstract 30).

Bortolussi et al., 2014, "Life-long correction of hyperbilirubinemia with a neonatal liver-specific AAV-mediated gene transfer in a lethal mouse model of Crigler-Najjar Syndrome" Hum. Gene. Ther., 25(9):844-855.

Boutin et al., 2010, "Prevalence of serum IgG and neutralizing factors against adeno-associated virus (AAV) types 1, 2, 5, 6, 8, and 9 in the healthy population: implications for gene therapy using AAV vectors," Hum. Gene Ther., 21(6):704-712.

Brimble et al., 2016, "New and improved AAVenues: current status of hemophilia B gene therapy," Expert Opin. Biol. Ther., 16(1):79-92 (Epub 2015).

Burton et al., 2015, "A randomized, placebo-controlled, double-blind study of sapropterin to treat ADHD symptoms and executive function impairment in children and adults with sapropterin-responsive phenylketonuria," Mol. Genet. Metab., 114(3):415-424.

Calcedo et al., 2009, "Worldwide epidemiology of neutralizing antibodies to adeno-associated viruses," J. Infect. Dis., 199(3):381-390.

Calcedo et al., 2011, "Adeno-associated virus antibody profiles in newborns, children, and adolescents," Clin. Vaccine Immunol., 18(9):1586-1588.

Carbonell et al., 1988, "Synthesis of a gene coding for an insect-specific scorpion neurotoxin and attempts to express it using baculovirus vectors," Gene, 73(2):409-418.

Chahal et al., 2014, "Production of adeno-associated virus (AAV) serotypes by transient transfection of HEK293 cell suspension cultures for gene delivery," J. Virol. Methods, 196:163-173 (Epub 2013).

Chicoine et al., 2014, "Plasmapheresis eliminates the negative impact of AAV antibodies on microdystrophin gene expression following vascular delivery," Mol. Ther., 22(2):338-347 (Epub 2013).

Chiorini et al., 1997, "Cloning of adeno-associated virus type 4 (AAV4) and generation of recombinant AAV4 particles," J. Virol., 71(9):6823-6833.

Chiorini et al., 1999, "Cloning and characterization of adeno-associated virus type 5," J. Virol., 73(2):1309-1319.

Chow et al., 1991, "Characterization of a novel liver-specific enhancer in the human prothrombin gene," J. Biol. Chem., 266(28):18927-18933.

Chu et al., 1981, "SV40 DNA transfection of cells in suspension: analysis of efficiency of transcription and translation of T-antigen," Gene., 13(2):197-202 and Errata.

ClinicalTrials.gov Identifier NCT03952156, "Gene Therapy Clinical Study in Adult PKU (pheNIX)," last updated Mar. 26, 2021 (9 pages).

Colella et al., 2017, "Emerging Issues in AAV-Mediated In Vivo Gene Therapy," Mol. Ther. Methods Clin Dev., 8:87-104.

(56) References Cited

OTHER PUBLICATIONS

Corti et al., 2014, "B-Cell Depletion is Protective Against Anti-AAV Capsid Immune Response: A Human Subject Case Study," Mol. Ther. Methods Clin Dev., 1:14033 (7 pages).
Costa et al., 1988, "The cell-specific enhancer of the mouse transthyretin (prealbumin) gene binds a common factor at one site and a liver-specific factor(s) at two other sites," Mol. Cell Biol., 8(1):81-90.
Cunningham et al., 2008, "Gene Delivery to the Juvenile Mouse Liver Using AAV2/8 Vectors," Mol. Ther., 16(6):1081-1088 (Epub 2016).
Dabkowska et al., 2012, "The effect of neutral helper lipids on the structure of cationic lipid monolayers," J. R. Soc. Interface, 9(68):548-561.
Dang et al., 1995, "Structure of the hepatic control region of the human apolipoprotein E/C-I gene locus," J. Biol. Chem., 270(38):22577-22585.
De Simone et al., 1987, "Cis- and trans-acting elements responsible for the cell-specific expression of the human alpha 1-antitrypsin gene," EMBO J., 6(9):2759-2766.
Eisensmith et al., 1996, "Somatic gene therapy for phenylketonuria and other hepatic deficiencies," J. Inherit Metab. Dis., 19(4):412-423.
Fagiuoli et al., 2013, "Monogenic diseases that can be cured by liver transplantation," J. Hepatol., 59(3):595-612.
Falese et al., 2017, "Strategy to detect pre-existing immunity to AAV gene therapy," Gene. Ther., 24(12):768-778.
Fang et al., 1994, "Gene therapy for phenylketonuria: phenotypic correction in a genetically deficient mouse model by adenovims-mediated hepatic gene transfer," Gene Ther., 1(4):247-254.
Frain et al., 1990, "Binding of a liver-specific factor to the human albumin gene promoter and enhancer," Mol. Cell Biol., 10(3):991-999.
Friesen et al., 1986, "The regulation of baculovims gene expression," Curr. Top. Microbiol. Immunol., 131:31-49.
Fu et al., 2017, "Differential Prevalence of Antibodies Against Adeno-Associated Virus in Healthy Children and Patients with Mucopolysaccharidosis III: Perspective for AAV-Mediated Gene Therapy," Hum. Gene. Ther. Clin. Dev., 28(4):187-196.
Gao et al., 2011, "Exploiting natural diversity of AAV for the design of vectors with novel properties," Methods Mol. Biol., 807:93-118.
GenBank Accession No. AAB95450.1, "capsid protein VP1 [Adeno-associated virus—6]," Jan. 12, 1998 (2 pages).
GenBank Accession No. AAB95452.1, "capsid protein VP1 [Adeno-associated virus 3B]," Jan. 12, 1998 (2 pages).
GenBank Accession No. AAT46337.1, "capsid protein [Adeno-associated virus 10]," Nov. 30, 2004 (2 pages).
GenBank Accession No. AAT46339.1, "capsid protein [Adeno-associated virus 11]," Nov. 30, 2004 (2 pages).
GenBank Accession No. ABI16639.1, "VP1 [Adeno-associated virus 12]," Feb. 20, 2008 (2 pages).
GenBank Accession No. ABZ10812.1, "capsid protein [Adeno-associated virus 13]," Sep. 23, 2008 (2 pages).
GenBank Accession No. AF028704.1, "Adeno-associated virus 6, complete genome," Jan. 12, 1998 (3 pages).
GenBank Accession No. AF028705.1, "Adeno-associated virus 3B, complete genome," Jan. 12, 1998 (3 pages).
GenBank Accession No. AF043303.1, "Adeno-associated virus 2, complete genome," May 20, 2010 (4 pages).
GenBank Accession No. AF085716.1, "Adeno-associated virus 5 DNA binding trs helicase (Rep22) and capsid protein (VP1) genes, complete cds," Feb. 9, 1999 (3 pages).
GenBank Accession No. AX753250.1, "Sequence 5 from Patent EP1310571," Jun. 23, 2003 (2 pages).
GenBank Accession No. AY631965.1, "Adeno-associated virus 10 nonstructural protein and capsid protein genes, complete cds," Nov. 30, 2004 (3 pages).
GenBank Accession No. AY631966.1, "Adeno-associated virus 11 nonstmctural protein and capsid protein genes, complete cds," Nov. 30, 2004 (3 pages).
GenBank Accession No. DQ813647.1, "Adeno-associated virus 12 Rep78 and VP1 genes, complete cds," Feb. 20, 2008 (3 pages).
GenBank Accession No. EU285562.1, "Adeno-associated virus 13 nonstmctural protein and capsid protein genes, complete cds," Sep. 23, 2008 (3 pages).
GenBank Accession No. J01901, "Adeno-associated virus 2, complete genome," Apr. 27, 1993 (3 pages).
GenBank Accession No. NC_001401.2, "Adeno-associated virus—2, complete genome," Aug. 13, 2018 (6 pages).
GenBank Accession No. NC_001729.1, "Adeno-associated virus—3, complete genome," Aug. 13, 2018 (3 pages).
GenBank Accession No. NC_001829.1, "Adeno-associated virus—4, complete genome," Aug. 13, 2018 (3 pages).
GenBank Accession No. NC_002077.1, "Adeno-associated virus—1, complete genome," Aug. 13, 2018 (3 pages).
GenBank Accession No. NC_006152.1, "Adeno-associated virus 5, complete genome," Aug. 13, 2018 (3 pages).
GenBank Accession No. NC_006260.1, "Adeno-associated virus—7, complete genome," Aug. 13, 2018 (3 pages).
GenBank Accession No. NC_006261.1, "Adeno-associated virus—8, complete genome," Aug. 13, 2018 (3 pages).
GenBank Accession No. NP_043941.1, "capsid protein [Adeno-associated virus—3]," Aug. 13, 2018 (2 pages).
GenBank Accession No. NP_044927.1, "capsid [Adeno-associated virus—4]," Aug. 13, 2018 (2 pages).
GenBank Accession No. U89790, "Adeno-associated virus 4, complete genome," Aug. 21, 1997 (3 pages).
GenBank Accession No. YP_068409.1, "capsid protein [Adeno-associated virus—5]," Aug. 13, 2018 (2 pages).
GenBank Accession No. YP_077178.1, "capsid protein [Adeno-associated virus—7]," Aug. 13, 2018 (2 pages).
GenBank Accession No. YP_077180.1, "capsid protein [Adeno-associated virus—8]," Aug. 13, 2018 (2 pages).
GenBank Accession No. YP_680426.1, "major coat protein VP1 [Adeno-associated virus—2]," Aug. 13, 2018 (2 pages).
George et al., 2017, "Hemophilia B Gene Therapy with a High-Specific-Activity Factor IX Variant," N. Engl. J. Med., 377(23):2215-2227.
Ghosh et al., 2007, "Expanding adeno-associated viral vector capacity: a tale of two vectors," Biotechnol. Genet. Eng. Rev., 24:165-177.
Gibson et al., 2009, "Enzymatic assembly of DNA molecules up to several hundred kilobases," Nat. Methods, 6(5):343-345.
Gibson et al., 2011, "Enzymatic assembly of overlapping DNA fragments," Methods Enzymol., 498:349-361.
Gnirke et al., 2009, "Solution hybrid selection with ultra-long oligonucleotides for massively parallel targeted sequencing," Nat. Biotechnol., 27(2):182-189.
Greenberg et al., 2016, "Prevalence of AAV1 neutralizing antibodies and consequences for a clinical trial of gene transfer for advanced heart failure," Gene. Ther., 23(3):313-319 (Epub 2015).
Grimm et al., 2008, "In vitro and in vivo gene therapy vector evolution via multispecies interbreeding and retargeting of adeno-associated viruses," J. Virol., 82(12):5887-5911.
Grosse et al., 2017, "Relevance of Assembly-Activating Protein for Adeno-associated Virus Vector Production and Capsid Protein Stability in Mammalian and Insect Cells," J. Virol., 91(20):e01198-17 (30 pages).
Halbert et al., 2000, "Repeat transduction in the mouse lung by using adeno-associated virus vectors with different serotypes," J. Virol., 74(3):1524-1532.
Halbert et al., 2006, "Prevalence of neutralizing antibodies against adeno-associated virus (AAV) types 2, 5, and 6 in cystic fibrosis and normal populations: Implications for gene therapy using AAV vectors," Hum. Gene. Ther., 17(4):440-447.
Hansal et al., 1998, "Induction of antigen-specific hyporesponsiveness by transplantation of hemopoietic cells containing an MHC class I transgene regulated by a lymphocyte-specific promoter," J. Immunol., 161(3):1063-1068.
Harding et al., 2006, "Complete correction of hyperphenylalaninemia following liver-directed, recombinant AAV2/8 vector-mediated gene therapy in murine phenylketonuria," Gene Ther., 13(5):457-462.

(56) References Cited

OTHER PUBLICATIONS

Harding, 2008, "Progress toward cell-directed therapy for phenylketonuria," Clin. Genet., 74(2):97-104.
Harris et al., 2011, "Comparison of a fluorogenic anti-FXa assay with a central laboratory chromogenic anti-FXa assay for measuring LMWH activity in patient plasmas," Thromb. Res., 128(6):e125-e129.
Hill et al., 1965, "An automated procedure for blood phenylalanine," Clin. Chem., 11:541-546.
Hinderer et al., 2018, "Severe Toxicity in Nonhuman Primates and Piglets Following High-Dose Intravenous Administration of an Adeno-Associated Virus Vector Expressing Human SMN," Hum. Gene. Ther., 29(3):285-298.
Hirosue et al., 2007, "Effect of inhibition of dynein function and microtubule-altering drugs on AAV2 transduction," Virology, 367(1):10-18.
Hirsch et al., 2010, "Little vector, big gene transduction: fragmented genome reassembly of adeno-associated virus," Mol. Ther., 18(1):6-8.
Hurlbut et al., 2010, "Preexisting immunity and low expression in primates highlight translational challenges for liver-directed AAV8-mediated gene therapy," Mol. Ther., 18(11):1983-1994.
International Search Report and Written Opinion for International Patent Application No. PCT/US2019/031252 (Pub No. WO 2019217513) dated Nov. 20, 2019 (21 pages).
International Search Report and Written Opinion for International Patent Application No. PCT/US2019/032092 (Pub No. WO 2019222132) dated Oct. 28, 2019 (21 pages).
International Search Report and Written Opinion for International Patent Application No. PCT/US2019/032097 (Pub No. WO 2019222136) dated Jan. 22, 2020 (16 pages).
International Search Report and Written Opinion for International Patent Application No. PCT/US2020/032560 (Pub No. WO 2020232044) dated Sep. 22, 2020 (11 pages).
Invitation to Pay Additional Fees accompanying Partial International Search Report and Provisional Opinion for International Patent Application No. PCT/US2019/032092 (Pub No. WO 2019222132) dated Sep. 9, 2019 (13 pages).
Invitation to Pay Additional Fees accompanying Partial International Search Report and Provisional Opinion for International Patent Application No. PCT/US2021/025486 dated Jul. 20, 2021 (15 pages).
Jacobs et al., 2011, "Adeno-associated viral vectors for correction of inborn errors of metabolism: progressing towards clinical application," Curr. Pharm. Des., 17(24):2500-2515.
Kajigaya et al., 1991, "Self-assembled B19 parvovirus capsids, produced in a baculovirus system, are antigenically and immunogenically similar to native virions," Proc. Natl. Acad. Sci. USA, 88(11):4646-4650.
Kato et al., 2010, "Silkworm expression system as a platform technology in life science," Appl. Microbiol. Biotechnol., 85(3):459-470.
Khan et al., 2019, "The phenylketonuria-associated substitution R68S converts phenylalanine hydroxylase to a constitutively active enzyme but reduces its stability," J. Biol. Chem., 294(12):4359-4367.
Kim et al., 1997, "Codon optimization for high-level expression of human erythropoietin (EPO) in mammalian cells," Gene, 199(1-2):293-301.
Kirnbauer et al., 1996, "Virus-like particles of bovine papillomavirus type 4 in prophylactic and therapeutic immunization," Virology, 219(1):37-44.
Knappskog et al., 1997, "Effect of mutations at Cys237 on the activation state and activity of human phenylalanine hydroxylase," FEBS Lett, 409(1):7-11.
Kok et al., 2013, "Adeno-associated virus-mediated rescue of neonatal lethality in argininosuccinate synthetase-deficient mice," Mol. Ther., 21(10):1823-1831.
Kurachi et al., 1995, "Role of intron I in expression of the human factor IX gene," J. Biol. Chem., 270(10):5276-5281.

La Du et al., 1963, "A quantitative micromethod for the determination of phenylalanine and tyrosine in blood and its application in the diagnosis of phenylketonuria in infants," Pediatrics, 31:39-46.
Laipis et al., 2003, "Recombinant AAV-based gene therapy of phenylketonuria in the Pah (enu2) missense mutant mouse," Mol. Ther., 7:S391-S392.
Lambert et al., 1995, "Regional 5-hydroxyindoleacetic acid production in humans," Life Sci., 57(3):255-267.
Lebacq-Veheyden et al., 1988, "Posttranslational processing of endogenous and of baculovirus-expressed human gastrin-releasing peptide precursor," Mol. Cell Biol., 8(8):3129-3135.
Li et al., 2012, "Neutralizing antibodies against adeno-associated virus examined prospectively in pediatric patients with hemophilia," Gene. Ther., 19(3):288-294.
Liu et al., 2013, "A practical guide to the monitoring and management of the complications of systemic corticosteroid therapy," Allergy Asthma Clin. Immunol., 9(1):30 (25 pages).
Liu et al., 2014, "Neutralizing antibodies against AAV2, AAV5 and AAV8 in healthy and HIV-1-infected subjects in China: implications for gene therapy using AAV vectors," Gene. Ther., 21 (8):732-738.
Luckow et al., 1988, "Trends in the development of baculovirus expression vectors," Nature Biotechnol., 6:47-55.
Maeda et al., 1985, "Production of human alpha-interferon in silkworm using a baculovirus vector," Nature, 315(6020):592-594.
Majowicz et al., 2017, "Successful Repeated Hepatic Gene Delivery in Mice and Non-human Primates Achieved by Sequential Administration of AAV5 ch and AAV1," Mol. Ther., 25(8):1831-1842.
Manno et al., 2006, "Successful transduction of liver in hemophilia by AAV-Factor IX and limitations imposed by the host immune response," Nat. Med., 12(3):342-347.
Martin et al., 1988, "Glycosylation and processing of high levels of active human glucocerebrosidase in invertebrate cells using a baculovirus expression vector," DNA, 7(2):99-106.
Masat et al., 2013, "Humoral immunity to AAV vectors in gene therapy: challenges and potential solutions," Discov. Med., 15(85):379-389.
Mccaman et al., 1962, "Fluorimetric method for the determination of phenylalanine in serum," J. Lab. Clin. Med., 59(5):885-890.
Mcintosh et al., 2012, "Successful attenuation of humoral immunity to viral capsid and transgenic protein following AAV-mediated gene transfer with a non-depleting CD4 antibody and cyclosporine," Gene. Ther., 19(1):78-85 (Epub 2011).
Mcintosh et al., 2013, "Therapeutic levels of FVIII following a single peripheral vein administration of rAAV vector encoding a novel human factor VIII variant," Blood, 121(17):3335-3344.
Mckenna et al., 1998, "Establishment of NewTrichoplusia niCell Lines in Serum-Free Medium for Baculovirus and Recombinant Protein Production," J. Invertebrate Pathology, 71(1):82-90.
Meadows et al., 2019, "Threshold for Pre-existing Antibody Levels Limiting Transduction Efficiency of Systemic rAAV9 Gene Delivery: Relevance for Translation," Mol. Ther. Methods Clin. Dev., 13:453-462.
Meliani et al., 2015, "Determination of anti-adeno-associated virus vector neutralizing antibody titer with an in vitro reporter system," Hum. Gene. Ther. Methods, 26(2):45-53.
Mendell et al., 2017, "Single-Dose Gene-Replacement Therapy for Spinal Muscular Atrophy" N. Engl. J. Med., 377:1713-1722.
Merrifield, 1963, "Solid Phase Peptide Synthesis. I. The Synthesis of a Tetrapeptide," J. Am. Chem. Soc., 85(14):2149-2154.
Miao et al., 2000, "Inclusion of the hepatic locus control region, an intron, and untranslated region increases and stabilizes hepatic factor IX gene expression in vivo but not in vitro," Mol. Ther., 1(6):522-532.
Miesbach et al., 2018, "Gene therapy with adeno-associated virus vector 5-human factor IX in adults with hemophilia B," Blood, 131(9):1022-1031 (Epub 2017).
Mietzsch et al., 2014, "OneBac: platform for scalable and high-titer production of adeno-associated virus serotype 1-12 vectors for gene therapy," Hum. Gene. Ther., 25(3):212-222.
Miller, 1988, "Baculoviruses as gene expression vectors," Annu. Rev. Microbiol., 42:177-199.
Mingozzi et al., 2007, "CD8(+) T-cell responses to adeno-associated virus capsid in humans," Nat. Med., 13(4):419-422.

(56) References Cited

OTHER PUBLICATIONS

Mingozzi et al., 2012, "Pharmacological modulation of humoral immunity in a nonhuman primate model of AAV gene transfer for hemophilia B," Mol. Ther., 20(7):1410-1416.
Mingozzi et al., 2013, "Prevalence and pharmacological modulation of humoral immunity to AAV vectors in gene transfer to synovial tissue," Gene. Ther., 20(4):417-424 (Epub 2012).
Mingozzi et al., 2017, "Overcoming the Host Immune Response to Adeno-Associated Virus Gene Delivery Vectors: The Race Between Clearance, Tolerance, Neutralization, and Escape," Annu. Rev. Virol., 4(1):511-534.
Mitchell et al., 2013, "Arsenic trioxide stabilizes accumulations of adeno-associated virus virions at the perinuclear region, increasing transduction in vitro and in vivo," J. Virol., 87(8):4571-4583.
Mitchell et al., 2013, "Mechanistic insights into the enhancement of adeno-associated virus transduction by proteasome inhibitors," J. Virol., 87(23):13035-13041.
Miyajima et al., 1987, "Use of the silkworm, Bombyx mori, and an insect baculovims vector for high-level expression and secretion of biologically active mouse interleukin-3," Gene, 58(2-3):273-281.
Miyamoto et al., 1957, "Competitive inhibition of mammalian tyrosinase by phenylalanine and its relationship to hair pigmentation in phenylketonuria," Nature, 179(4552):199-200.
Mochizuki et al., 2004, "Long-term correction of hyperphenylalaninemia by AAV-mediated gene transfer leads to behavioral recovery in phenylketonuria mice," Gene. Ther., 11(13):1081-1086.
Moskalenko et al., 2000, "Epitope mapping of human anti-adeno-associated virus type 2 neutralizing antibodies: implications for gene therapy and virus structure," J. Virol., 74(4):1761-1766.
Muyldermans et al., 2001, "Single domain camel antibodies: current status," J. Biotechnol., 74(4):277-302.
Nagasaki et al., 1999, "Reversal of hypopigmentation in phenylketonuria mice by adenovirus-mediated gene transfer," Pediatr. Res., 45:465-473.
Nathwani et al., 2006, "Self-complementary adeno-associated virus vectors containing a novel liver-specific human factor IX expression cassette enable highly efficient transduction of murine and nonhuman primate liver," Blood, 107(7):2653-2661.
Nathwani et al., 2007, "Safe and efficient transduction of the liver after peripheral vein infusion of self-complementary AAV vector results in stable therapeutic expression of human FIX in nonhuman primates," Blood, 109(4):1414-1421.
Nathwani et al., 2011, "Adenovims-associated virus vector-mediated gene transfer in hemophilia B," N. Engl. J. Med., 365(25):2357-2365.
Nathwani et al., 2014, "Long-term safety and efficacy of factor IX gene therapy in hemophilia B," N. Engl. J. Med., 371(21):1994-2004.
Nonnenmacher et al., 2012, "Intracellular transport of recombinant adeno-associated virus vectors," Gene. Ther., 19(6):649-658.
Oh et al., 2004, "Long-term enzymatic and phenotypic correction in the phenylketonuria mouse model by adeno-associated virus vector-mediated gene transfer," Pediatr. Res., 56(2):278-284.
Ojala et al., 2018, "In Vivo Selection of a Computationally Designed SCHEMA AAV Library Yields a Novel Variant for Infection of Adult Neural Stem Cells in the SVZ," Mol. Ther., 26(1):304-319 (Epub 2017).
Okuyama et al., 1996, "Liver-directed gene therapy: a retroviral vector with a complete LTR and the ApoE enhancer-alpha 1-antitrypsin promoter dramatically increases expression of human alpha 1-antitiypsin in vivo," Hum, Gene Ther., 7(5):637-645.
Olson et al., 1998, "College of American Pathologists Conference XXXI on laboratory monitoring of anticoagulant therapy: laboratory monitoring of unfractionated heparin therapy," Arch. Pathol. Lab. Med., 122(9):782-798.
Peden et al., 2009, "Striatal readministration of rAAV vectors reveals an immune response against AAV2 capsids that can be circumvented," Mol. Ther., 17(3):524-537.

Peterson et al., 1988, "Blood phenylalanine estimation for the patient with phenylketonuria using a portable device," Biochem. Med. Metab. Biol., 39(1):98-104.
Pey et al., 2008, "Identification of pharmacological chaperones as potential therapeutic agents to treat phenylketonuria," J. Clin Invest., 118(8):2858-2867.
Rangarajan et al., 2017, "AAV5-Factor VIII Gene Transfer in Severe Hemophilia A," N. Engl. J. Med., 377(26):2519-2530.
Rodrigues et al., 2018, "Pharmaceutical Development of AAV-Based Gene Therapy Products for the Eye," Pharm. Res., 36(2):29 (20 pages).
Ronzitti et al., 2016, "A translationally optimized AAV-UGT1A1 vector drives safe and long-lasting correction of Crigler-Najjar syndrome," Mol. Ther. Methods Clin. Dev., 3:16049 (10 pages).
Rouet et al., 1992, "A potent enhancer made of clustered liver-specific elements in the transcription control sequences of human alpha 1-microglobulin/bikunin gene," J. Biol. Chem., 267(29):20765-20773.
Rouet et al., 1995, "Hierarchy and positive/negative interplays of the hepatocyte nuclear factors HNF-1, -3 and -4 in the liver-specific enhancer for the human alpha-1-microglobulin/bikunin precursor," Nucleic Acids Res., 23(3):395-404.
Rouet et al., 1998, "An array of binding sites for hepatocyte nuclear factor 4 of high and low affinities modulates the liver-specific enhancer for the human alphal-microglobulin/bikunin precursor," Biochem. J., 334 (Pt 3):577-584.
Ruddell et al., 2008, "The function of serotonin within the liver," J. Hepatol., 48(4):666-675.
Rudy et al., 1987, "Phenylalanine and tyrosine in serum and eluates from dried blood spots as determined by reversed-phase liquid chromatography," Clin. Chem., 33(7):1152-1154.
Ruffing et al., 1992, "Assembly of viruslike particles by recombinant structural proteins of adeno-associated virus type 2 in insect cells," J. Virol., 66(12):6922-6930.
Russell et al., 2017, "Efficacy and safety of voretigene neparvovec (AAV2-hRPE65v2) in patients with RPE65-mediated inherited retinal dystrophy: a randomised, controlled, open-label, phase 3 trial," Lancet, 390(10097):849-860.
Rutledge et al., 1998, "Infectious clones and vectors derived from adeno-associated virus (AAV) serotypes other than AAV type 2," J. Virol., 72(1):309-319.
Samulski et al., 1989, "Helper-free stocks of recombinant adeno-associated viruses: normal integration does not require viral gene expression," J. Virol., 63(9):3822-3828.
Sandberg et al., 2001, "Structural and functional characteristics of the B-domain-deleted recombinant factor VIII protein, r-VIII SQ," Thromb. Haemost., 85(1):93-100.
Sands, 2011, "AAV-mediated liver-directed gene therapy," Methods Mol. Biol., 807:141-157.
Santos-Sierra et al., 2012, "Novel pharmacological chaperones that correct phenylketonuria in mice," Hum. Mol. Genet, 21(8):1877-1887.
Sawin et al., 2014, "Differential effects of low-phenylalanine protein sources on brain neurotransmitters and behavior in C57B1/6-Pah(enu2) mice," Mol. Genet. Metab., 111(4):452-461.
Scallan et al., 2006, "Human immunoglobulin inhibits liver transduction by AAV vectors at low AAV2 neutralizing titers in SCID mice," Blood, 107(5):1810-1817 (Epub 2005).
Schnepp et al., 2005, "Characterization of adeno-associated virus genomes isolated from human tissues," J. Virol., 79(23):14793-14803.
Schuck et al., 2015, "Phenylketonuria Pathophysiology: on the Role of Metabolic Alterations," Aginod Dis., 6(5):390-399.
Shachter et al., 1993, "Localization of a liver-specific enhancer in the apolipoprotein E/C-I/C-II gene locus," J. Lipid Res., 34(10):1699-1707.
Sharp et al., 1987, "The codon Adaptation Index—a measure of directional synonymous codon usage bias, and its potential applications," Nucleic Acids Res., 15(3):1281-1295.
Shedlovsky et al., 1993, "Mouse models of human phenylketonuria," Genetics, 134(4):1205-1210.

(56) References Cited

OTHER PUBLICATIONS

Smith et al., 1985, "Modification and secretion of human interleukin 2 produced in insect cells by a baculovirus expression vector," Proc. Natl. Acad. Sci. USA, 82(24):8404-8408.
Soriano et al., 2002, "Gene therapy and pediatric liver disease," J. Pediatr. Gastroenterol. Nutr., 35 Suppl 1:S51-S54.
Srivastava et al., 1983, "Nucleotide sequence and organization of the adeno-associated virus 2 genome," J. Virol., 45(2):555-564.
Sun et al., 2013, "Assessment of a passive immunity mouse model to quantitatively analyze the impact of neutralizing antibodies on adeno-associated virus-mediated gene transfer," J. Immunol. Methods, 387(1-2):114-120 (Epub 2012).
Thomas et al., 2018, "Pegvaliase for the treatment of phenylketonuria: Results of a long-term phase 3 clinical trial program (PRISM)," Mol. Genet. Metab., 124(1):27-38.
Tsukerman, 1985, "Simple method of mass screening for phenylketonuria," Lab. Delo., 6:326-327 (in Russian with English abstract).
Viecelli et al., 2014, "Treatment of phenylketonuria using minicircle-based naked-DNA gene transfer to murine liver," Hepatology, 60(3):1035-1043.
Viecelli et al., 2016, "Minicircles show improved hepatic expression of their transgene from a natural endogenous promoter and are lost upon partial hepatectomy due to the episomal nature of the vector," Mol. Ther., 24(1):S142.
Virella-Lowell et al., 2000, "Inhibition of recombinant adeno-associated virus (rAAV) transduction by bronchial secretions from cystic fibrosis patients," Gene. Ther., 7(20):1783-1789.
Vlak et al., 1988, "Functional studies on the p10 gene of Autographa californica nuclear polyhedrosis virus using a recombinant expressing a p10-beta-galactosidase fusion gene," J. Gen. Virol., 69:765-776.
Wang et al., 1999, "Sustained correction of bleeding disorder in hemophilia B mice by gene therapy," Proc. Natl. Acad. Sci. USA, 96(7):3906-3910.
Wang et al., 2001, "Mutagenesis of the regulatory domain of phenylalanine hydroxylase," Proc. Natl. Acad. Sci. USA, 98(4):1537-1542.
Wang et al., 2010, "The pleiotropic effects of natural AAV infections on liver-directed gene transfer in macaques," Mol. Ther., 18(1):126-134 (Epub 2009).
Wang et al., 2012, "Hepatic gene transfer in neonatal mice by adeno-associated virus serotype 8 vector," Hum Gene. Ther., 23(5):533-539.
Ward et al., 2011, "Codon optimization of human factor VIII cDNAs leads to high-level expression," Blood, 117(3):798-807 (Epub 2010).
Weinberg et al., 2014, "Recombinant adeno-associated virus utilizes cell-specific infectious entry mechanisms," J. Virol., 88(21):12472-12484.
Winn et al., 2018, "Blood phenylalanine reduction corrects CNS dopamine and serotonin deficiencies and partially improves behavioral performance in adult phenylketonuric mice," Mol. Genet. Metab., 123(1):6-20.
Wong et al., 2016, "Benzoyl chloride derivatization with liquid chromatography-mass spectrometry for targeted metabolomics of neurochemicals in biological samples," J. Chromatogr. A., 1446:78-90.
Wu et al., 2000, "Mutational analysis of the adeno-associated virus type 2 (AAV2) capsid gene and construction of AAV2 vectors with altered tropism," J. Virol., 74(18):8635-8647.
Yan et al., 2005, "Inverted terminal repeat sequences are important for intermolecular recombination and circularization of adeno-associated virus genomes," J. Virol., 79(1):364-379.
Yan et al., 2012, "Human thyroxine binding globulin (TBG) promoter directs efficient and sustaining transgene expression in liver-specific pattern," Gene, 506(2):289-294.
Yano et al., 2016, "Evaluation of Tetrahydrobiopterin Therapy with Large Neutral Amino Acid Supplementation in Phenylketonuria: Effects on Potential Peripheral Biomarkers, Melatonin and Dopamine, for Brain Monoamine Neurotransmitters," PLoS One, 11(8):e0160892 (14 pages).
Zhao et al., 2000, "BPV1 E2 protein enhances packaging of full-length plasmid DNA in BPV1 pseudovirions," Virology, 272(2):382-393.
Zincarelli et al., 2008, "Analysis of AAV serotypes 1-9 mediated gene expression and tropism in mice after systemic injection," Mol. Ther., 16(6):1073-1080.
Zur Megede et al., 2000, "Increased expression and immunogenicity of sequence-modified human immunodeficiency virus type 1 gag gene," J. Virol., 74(6):2628-2635.
Andersen et al., Herpesvirus-mediated gene delivery into the rat brain: specificity and efficiency of the neuron-specific enolase promoter, Cell Mol. Neurobiol., 13(5):503-15 (1993).
Arbuthnot et al., In vitro and in vivo hepatoma cell-specific expression of a gene transferred with an adenoviral vector, Hum. Gene Ther., 7(13):1503-14 (1996).
Bello et al., Novel adeno-associated viruses derived from pig tissues transduce most major organs in mice, Sci. Rep., 4:6644 (Oct. 2014).
Boshart et al., A very strong enhancer is located upstream of an immediate early gene of human cytomegalovirus, Cell, 41(2):521-30 (1985).
Chen et al., Expression of rat bone sialoprotein promoter in transgenic mice, J. Bone Miner. Res., 11(5):654-64 (1996).
Chu et al., SV40 DNA transfection of cells in suspension: analysis of efficiency of transcription and translation of T-antigen, Gene, 13(2):197-202 (Mar. 1981).
Deverman et al., Cre-dependent selection yields AAV variants for widespread gene transfer to the adult brain, Nat. Biotechnol., 34(2):204-9 (2016).
Donnelly et al., The cleavage activities of aphthovirus and cardiovirus 2A proteins, J. Gen. Virol., 78(Pt. 1):13-21 (1997).
EBI Accession No. UniProt A0A0K1P7V4, Capside Protein, Nov. 11, 2015.
Furler et al., Recombinant AAV vectors containing the foot and mouth disease virus 2A sequence confer efficient bicistronic gene expression in cultured cells and rat substantia nigra neurons, Gene Ther., 8(11):864-73 (2001).
Gao et al., Adeno-associated viruses undergo substantial evolution in primates during natural infections, Proc. Natl. Acad. Sci. USA, 100(10):6081-6 (May 2003).
Gao et al., Clades of Adeno-associated viruses are widely disseminated in human tissues, J. Virol., 78(12):6381-8 (Jun. 2004).
Gossen et al., Tight control of gene expression in mammalian cells by tetracycline-responsive promoters, Proc. Natl. Acad. Sci. USA, 89(12):5547-51 (1992).
Gossen et al., Transcriptional activation by tetracyclines in mammalian cells, Science, 268(5218):1766-9 (1995).
Graham et al., A new technique for the assay of infectivity of human adenovirus 5 DNA, Virology, 5292):456-67 (Apr. 1973).
Harvey et al., Inducible control of gene expression: prospects for gene therapy, Curr. Opin. Chem. Biol., 2(4):512-8 (1998).
Hauck et al., Characterization of tissue tropism determinants of adeno-associated virus type 1, J. Virol., 77(4):2768-74 (Feb. 2003).
International Application No. PCT/US2017/043703, International Search Report and Written Opinion, dated Feb. 7, 2018.
Klump et al., Retroviral vector-mediated expression of HoxB4 in hematopoietic cells using a novel coexpression strategy, Gene Ther., 8(10):811-7 (2001).
Kotin, Prospects for the use of adeno-associated virus as a vector for human gene therapy, Hum. Gene Ther., 5(7):793-801 (Jul. 1994).
Li et al., Synthetic muscle promoters: activities exceeding naturally occurring regulatory sequences, Nat. Biotechnol., 17(3):241-5 (1999).
Magari et al., Pharmacologic control of a humanized gene therapy system implanted into nude mice, J. Clin. Invest., 100(11):2865-72 (1997).
Marsic et al., Vector design Tour de Force: integrating combinatorial and rational approaches to derive novel adeno-associated virus variants, Mol. Ther., 22(11):1900-9 (Nov. 2014).

(56) References Cited

OTHER PUBLICATIONS

Mays et al., Mapping the structural determinants responsible for enhanced T cell activation to the immunogenic adeno-associated virus capsid from isolate rhesus 32.33, J. Virol., 87(17):9473-85 (Sep. 2013).

Miyatake et al., Transcriptional targeting of herpes simplex virus for cell-specific replication, J. Virol., 71 (7):5124-32 (1997).

Muzyczka, Use of adeno-associated virus as a general transduction vector for mammalian cells, Curr. Top. Microbiol. Immunol., 158:97-129 (1992).

No et al., Ecdysone-inducible gene expression in mammalian cells and transgenic mice, Proc. Natl. Acad. Sci. USA, 93(8):3346-51 (1996).

Piccioli et al., Neuroantibodies: ectopic expression of a recombinant anti-substance P antibody in the central nervous system of transgenic mice, Neuron., 15(2):373-84 (1995).

Piccioli et al., Neuroantibodies: molecular cloning of a monoclonal antibody against substance P for expression in the central nervous system, Proc. Natl. Acad. Sci. USA, 88(13):5611-5 (1991).

Ruffing et al., Mutations in the carboxy terminus of adeno-associated virus 2 capsid proteins affect viral infectivity: lack of an RGD integrin-binding motif, J. Gen. Virol., 75(Pt. 2):3385-92 (Dec. 1994).

Sandig et al., HBV-derived promoters direct liver-specific expression of an adenovirally transduced LDL receptor gene, Gene Ther., 3(11):1002-9 (1996).

Stein et al., The osteocalcin gene: a model for multiple parameters of skeletal-specific transcriptional control, Mol. Biol. Rep., 24(3):185-96 (1997).

Wang et al., Ligand-inducible and liver-specific target gene expression in transgenic mice, Nat. Biotechnol., 15(3):239-43 (1997).

Wang et al., Positive and negative regulation of gene expression in eukaryotic cells with an inducible transcriptional regulator, Gene Ther., 4(5):432-41 (1997).

Zinn et al., In Silico Reconstruction of the Viral Evolutionary Lineage Yields a Potent Gene Therapy Vector, Cell Rep., 12(6):1056-68 (Aug. 2015).

Svyatchenko et al., 2012, "Oncolytic Adenoviruses in Anti-Cancer Therapy: Current Status and Perspectives," Molekuliamaia Biologiia, 46(4):556-569 (in Russian with English abstract).

International Search Report and Written Opinion for International Patent Application No. PCT/US2021/025486 dated Sep. 10, 2021 (20 pages).

Appel et al., 2014, "Nucleic acids: From A to Z," edited by S. Muller, p. 27 (in Russian with English translation).

Bowles et al., 2003, "Marker rescue of adeno-associated virus (AAV) capsid mutants: a novel approach for chimeric AAV production," J. Virol., 77(1):423-432.

GenBank Accession No. HZ323618.1, "JP 2015518705-A/1411: Modified Polynucleotides for the Production of Biologies and Proteins Associated with Human Disease," Nov. 26, 2015 (2 pages).

GenBank Accession No. JC111928.1, "Sequence 573 from Patent WO2013151666," Jan. 28, 2014 (2 pages).

Shen et al., 2007, "Characterization of the relationship of AAV capsid domain swapping to liver transduction efficiency," Mol. Ther., 15(11):1955-1962.

Hafid et al., 2015, "Phenylketonuria: a review of current and future treatments," Transl. Pediatr., 4(4):304-317.

Wang et al., 2000, "Adeno-associated virus vector carrying human minidystrophin genes effectively ameliorates muscular dystrophy in mdx mouse model," Proc. Natl. Acad. Sci. USA, 97(25):13714-13719.

\* cited by examiner

ADENO-ASSOCIATED VIRUS CAPSID PROTEINS

This application is a U.S. National Stage Application under 35 U.S.C. § 371 of International Patent Application No. PCT/US2017/043703, filed Jul. 25, 2017, which claims the benefit of U.S. Provisional Application No. 62/366,838, filed Jul. 26, 2016, the disclosure of each of which is incorporated by reference herein in its entirety.

FIELD OF INVENTION

The invention relates to novel adeno-associated virus (AAV) capsid proteins, AAV particles comprising a novel capsid protein, polynucleotides encoding these capsid proteins and AAV vectors expressing these capsid proteins. The invention also relates to methods of making the herein described AAV vectors expressing the novel capsid proteins of the invention and associated therapeutic uses thereof.

BACKGROUND

AAV is a replication-deficient parvovirus, the single-stranded DNA genome of which is about 4.7 kb in length including 145 nucleotide inverted terminal repeat (ITRs). The nucleotide sequence of the AAV serotype 2 (AAV2) genome is presented in Srivastava et al., *J. Virol.*, 45: 555-564 (1983) as corrected by Ruffing et al., *J. Gen. Virol.*, 75: 3385-3392 (1994). Cis-acting sequences directing viral DNA replication (rep), encapsidation/packaging and host cell chromosome integration are contained within the ITRs. Three AAV promoters, p5, p19, and p40 (named for their relative map locations), drive the expression of the two AAV internal open reading frames encoding rep and cap genes. The two rep promoters (p5 and p19), coupled with the differential splicing of the single AAV intron (at nucleotides 2107 and 2227), result in the production of four rep proteins (rep 78, rep 68, rep 52, and rep 40) from the rep gene. Rep proteins possess multiple enzymatic properties which are ultimately responsible for replicating the viral genome. The cap gene is expressed from the p40 promoter and it encodes the three capsid proteins VP1, VP2, and VP3. Alternative splicing and a non-consensus translational start site are responsible for the production of the three related capsid proteins. A single consensus polyadenylation site is located at map position 95 of the AAV genome. The life cycle and genetics of AAV are reviewed in Muzyczka, *Current Topics in Microbiology and Immunology*, 158: 97-129 (1992).

When AAV infects a human cell, the viral genome can integrate into chromosome 19 resulting in latent infection of the cell. Production of infectious virus does not occur unless the cell is infected with a helper virus (for example, adenovirus or herpesvirus). In the case of adenovirus, genes E1A, E1B, E2A, E4 and VA provide helper functions. Upon infection with a helper virus, the AAV provirus is rescued and amplified, and both AAV and adenovirus are produced.

AAV possesses unique features that make it attractive as a vaccine vector for expressing immunogenic peptides/polypeptides and as a vector for delivering foreign DNA to cells, for example, in gene therapy. AAV infection of cells in culture is non-cytopathic, and natural infection of humans and other animals is silent and asymptomatic. Moreover, AAV infects many mammalian cells allowing the possibility of targeting many different tissues in vivo. The AAV proviral genome is infectious as cloned DNA in plasmids which makes construction of recombinant genomes feasible. Furthermore, because the signals directing AAV replication, genome encapsidation and integration are contained within the ITRs of the AAV genome, some or all of the internal approximately 4.3 kb of the genome (encoding replication and structural capsid proteins, rep-cap) may be replaced with foreign DNA such as a gene cassette containing a promoter, a DNA of interest and a polyadenylation signal. The rep and cap proteins may be provided in trans. Another significant feature of AAV is that it is an extremely stable and hearty virus. It easily withstands the conditions used to inactivate adenovirus (56° to 65° C. for several hours), making cold preservation of rAAV-vectors less critical. AAV may even be lyophilized. Finally, AAV-infected cells are not resistant to superinfection.

AAV vectors find use in numerous mammalian gene therapy applications and there is a need for new and/or modified AAV vectors and associated virus that find use in gene therapy applications. The present invention provides for novel AAV vectors expressing the novel AAV capsid proteins or the functional chimeric engineered AAV capsid proteins of the present invention, and novel, non-naturally occurring AAV virions comprising those vectors or capsid proteins.

SUMMARY OF INVENTION

The invention provides for novel AAV capsid proteins, which may be novel VP1, VP2 or VP3 capsid proteins, non-naturally occurring AAV virus comprising any of these capsid proteins, and use of such AAV virus for gene therapy applications and for use in the preparation of medicaments for gene therapy applications. In some embodiments, the AAV capsid proteins were isolated and identified from various mammalian tissues. The amino acid sequences of certain novel mammalian-derived AAV capsid VP1 proteins are set out as SEQ ID NOS:15-89, and the associated locations of the respective VP2 and VP3 sequences are also herein described. In addition, the invention provides for novel engineered chimeric AAV capsid proteins which have a backbone amino acid sequence derived from one AAV capsid sequence and fragments of capsid protein sequence derived from at least one different AAV capsid sequence. The amino acid sequences of exemplary engineered chimeric AAV capsid VP1 proteins are set out as SEQ ID NOS: 90-157. Collectively, the novel capsid proteins are referred to herein as "AAV capsid proteins of the invention." The term "non-naturally occurring" when used in regards to any composition of matter described herein means that the composition is not a product of nature, but rather is artificially synthesized by recombinant or other means.

In one embodiment the invention provides a vector and an adeno-associated virus (AAV) having a capsid protein having an amino acid sequence that is at least 95% identical to (i) any one of SEQ ID NOS:15-89, (ii) the VP2 region of any one of SEQ ID NOS:15-89, or (iii) the VP3 region of any one of SEQ ID NOS:15-89, and further having a transgene where the transgene is composed of a heterologous gene operably linked to regulatory sequences that control expression of the heterologous gene in a host cell. In another embodiment the capsid protein has the amino acid sequence of i) any one of SEQ ID NOS:15-89, (ii) the VP2 region of any one of SEQ ID NOS:15-89, or (iii) the VP3 region of any one of SEQ ID NOS:15-89. In yet another embodiment the AAV has an AAV inverted terminal repeat sequence. In further embodiments the AAV are mixed with a physiologically compatible carrier.

In another embodiment the invention provides a vector and an AAV having a chimeric capsid protein where the chimeric capsid protein has a VP1 amino acid sequence of a recipient backbone AAV capsid having variable regions I, II, III, IV, V, VI, VII, VIII, and IX, except where one or more of the variable regions I, II, III, IV, V, VI, VII, VIII, and IX is replaced by the corresponding variable region from one or more donor AAV capsids. In another embodiment, only one variable region of the recipient capsid is replaced by the corresponding variable region from the donor capsid. In a further embodiment, two or more variable regions of the recipient capsid are replaced by the corresponding variable regions from a single donor AAV capsid. In yet another embodiment, two or more variable regions of the recipient AAV capsid are replaced by the corresponding variable regions from two or more donor AAV capsids. In another embodiment, all nine variable regions of the recipient AAV capsid are replaced by the corresponding variable regions from a single donor capsid. In yet another embodiment the recipient AAV capsid has a GBS region or a GH loop region and the GBS region or the GH loop region is replaced by the corresponding region from one or more donor AAV capsids. In a further embodiment all nine variable regions and the GBS region of the recipient AAV capsid are replaced by the corresponding variable regions and GBS region from one or more donor AAV capsids. In yet another embodiment all nine variable regions and the GBS region of the recipient AAV capsid are replaced by the corresponding regions and GBS region from two or more donor AAV capsids. In another embodiment the GH loop of the recipient AAV capsid is replaced by the corresponding GH loop region from a donor AAV capsid. In a further embodiment all nine variable regions and the GH loop region of the recipient AAV capsid are replaced by the corresponding variable regions and GH loop region from one or more donor AAV capsids. In one embodiment the recipient AAV capsid sequence is any one of SEQ ID NOS:1-14 and the donor AAV capsid sequences are selected from any one of SEQ ID NOS:1-14 and where the recipient AAV capsid and the donor AAV capsid are different. In another embodiment the recipient AAV capsid sequence is any one of SEQ ID NOS:1-89 and the donor AAV capsid sequences are selected from any one of SEQ ID NOS:1-89 and where the recipient AAV capsid and the donor AAV capsid are different. In yet another embodiment the chimeric capsid has the amino acid sequence of any one of SEQ ID NOS:90-157.

In another embodiment, the invention provides a method of delivering a transgene to a cell involving the step of contacting the cell with any AAV disclosed herein. In another embodiment, the invention provides a method of treating a subject from a disorder or disease associated with abnormal activity of an endogenous protein involving the step of administering to the subject an effective amount of an AAV disclosed herein where the AAV has a transgene that encodes a biologically active copy of the protein. In yet another embodiment, the methods involve delivering a transgene to a muscle cell. In a further embodiment, the disease is Duchenne muscular dystrophy and the transgene encodes a microdystrophin.

In an embodiment, the invention provides a composition comprising a vector or AAV disclosed herein for delivery of a transgene to a cell. In another embodiment, the invention provides a composition comprising an effective amount of a vector or AAV disclosed herein for the treatment of a disorder or disease associated with abnormal activity of an endogenous protein, wherein the vector of AAV has a transgene that encodes a biologically active copy of the protein. In yet another embodiment, the composition delivers a transgene to a muscle cell. In a further embodiment, the disease is Duchenne muscular dystrophy and the transgene encodes a microdystrophin.

The invention also invention provides use of a vector or AAV disclosed herein for the preparation of a medicament effective to treat a subject suffering from a disorder or disease associated with abnormal activity of an endogenous protein, wherein the vector or AAV has a transgene that encodes a biologically active copy of the protein. In yet another embodiment, the medicament delivers a transgene to a muscle cell. In a further embodiment the disease is Duchenne muscular dystrophy and the transgene encodes a microdystrophin.

The invention provides for fragments of any of the AAV capsid proteins of the invention that retain a biological activity of an AAV capsid protein. Exemplary fragments include VP2 and VP3 spliced variants of the capsid proteins, and fragments comprising one or more of the variable regions (VR) of the capsid protein and/or the glycan binding sequence (GBS) of a capsid protein and/or the GH loop. The invention also provides for novel, non-naturally occurring AAV particles comprising a capsid protein fragment and those comprising a capsid protein fragment having at least 90, 91, 92, 93, 94, 95, 96, 97, 98 or 99% sequence identity to a specifically defined capsid protein fragment.

In one embodiment, the invention provides for an isolated adeno-associated virus (AAV) capsid protein, wherein the capsid protein comprises (i) an amino acid sequence that is at least 95%, 96%, 97%, 98%, or 99% identical to the VP1 amino acid sequence of any one of SEQ ID NOS:15-89 or the VP2 or VP3 region of any one of SEQ ID NOS:15-89 or (ii) a VP1 amino acid sequence comprising any one of SEQ ID NOS:15-89 or the VP2 or VP3 region of any one of SEQ ID NOS:15-89. In certain embodiments, the capsid protein is linked to a heterologous amino acid sequence. The invention also provides for non-naturally occurring AAV particles having or comprising any of these capsid proteins. In certain embodiments, the non-naturally occurring AAV particle comprising any of the above described VP1, VP2 or VP3 capsid proteins comprises a nucleic acid having AAV inverted terminal repeats and a transgene comprising a heterologous gene operably linked to regulatory sequences which direct expression of the heterologous gene in a host cell. In other embodiments, the non-naturally occurring AAV particle comprising any of the VP1, VP2 or VP3 capsid sequences described herein comprises a heterologous transgene operably linked to regulatory sequences that control transgene expression in a host cell. As used herein, the terms "heterologous gene" or "heterologous regulatory sequence" means that the referenced gene or regulatory sequence is not naturally present in the AAV vector or particle and is artificially introduced therein. The term "transgene" refers to a nucleic acid that comprises both a heterologous gene and regulatory sequences that are operably linked to the heterologous gene that control expression of that gene in a host cell.

The invention also provides for a polynucleotide comprising a nucleotide sequence encoding an adeno-associated virus (AAV) capsid protein, wherein the capsid protein comprises (i) an amino acid sequence that is at least 95%, 96%, 97%, 98% or 99% identical to the VP1 amino acid sequence of any one of SEQ ID NOS:15-89 or the VP2 or VP3 region of any one of SEQ ID NOS:15-89 or (ii) a VP1 amino acid sequence comprising any one of SEQ ID NOS: 15-89 or the VP2 or VP3 region of any one of SEQ ID NOS:15-89, wherein the polynucleotide is operatively linked to a heterologous regulatory control sequence. As such, it is understood that the polynucleotides of the present invention are non-naturally occurring. The invention also provides for AAV vectors comprising any of these polynucleotide sequences operably linked to a heterologous regulatory sequence and compositions comprising these AAV vectors, including pharmaceutical compositions.

In another embodiment, the invention provides for an isolated adeno-associated virus (AAV) vector comprising a polynucleotide sequence encoding a capsid protein and a heterologous transgene sequence, wherein the capsid protein comprises (i) an amino acid sequence that is at least 95%, 96%, 97%, 98% or 99% identical to the VP1 amino acid sequence of any one of SEQ ID NOS:15-89 or the VP2 or VP3 region of any one of SEQ ID NOS:15-89 or (ii) a VP1 amino acid sequence comprising any one of SEQ ID NOS: 15-89 or the VP2 or VP3 region of any one of SEQ ID NOS:15-89. The invention also provides for compositions comprising these AAV vectors, including pharmaceutical compositions.

The present invention is also based upon the novel finding described herein that AAV VP1 capsid sequences comprise nine different variable regions, a GBS region and a GH loop region, and that replacing one or more of these regions in one AAV VP1 capsid sequence with the corresponding region(s) from an at least second, different AAV VP1 capsid sequence can generate novel chimeric AAV capsids whose associated AAVs are functional, are capable of transducing cells and delivering heterologous transgenes, and that have unique properties that may be recombinantly engineered into the chimeric AAV. In regards to the various variable regions and the GBS and GH loop regions, the term "corresponding" means the same region between two different AAV capsid sequences. For example, the region "corresponding" to VR I in a first AAV capsid sequence is the same region (i.e., the VR I region) in a second different AAV capsid sequence. The term "chimeric" in relation to an AAV capsid sequence refers to the fact that the AAV capsid sequence of interest comprises amino acid sequences derived from two or more different AAV capsid sequences.

As such, the present invention also provides for an isolated, non-naturally occurring chimeric adeno-associated virus (AAV) capsid protein, wherein the chimeric capsid protein comprises an amino acid sequence derived from a first AAV capsid sequence having at least one variable region substituted with a variable region from a second AAV capsid sequence that is different from the first AAV capsid sequence. The first AAV capsid sequence (referred to herein as the "recipient") provides the backbone amino acid sequence into which one or more variable regions are swapped or substituted by one or more variable regions from the second AAV capsid sequence (referred to herein as the "donor"). The second AAV capsid sequence is different from the first AAV capsid sequence and will provide the sequence of the variable region(s) which is/are substituted or inserted into the sequence of the backbone or recipient capsid sequence. The invention also provides for non-naturally occurring AAV virus or AAV particles that comprise any of the chimeric capsid proteins herein described. In certain embodiments, the non-naturally occurring AAV particles that comprise any of the chimeric capsid proteins herein described also comprise a heterologous transgene operably linked to regulatory sequences that control transgene expression in a host cell.

The "variable regions" that may be swapped from a donor AAV capsid sequence into a recipient backbone capsid sequence refer to the nine variable regions within the VP1 sequence of an AAV capsid protein. The variable regions (VR) are referred to herein as VR I, VR II, VR III VR IV, VR V, VR VI, VR VII, VR VIII and VR IX and their respective locations in various VP1 sequences are herein described. The VR exhibit the highest sequence and structural variation within the AAV VP1 capsid sequence and may also have roles in receptor attachment, transcriptional activation of transgenes, tissue transduction and antigenicity.

The "glycan binding sequence (GBS)" or 'GBS domain" or "GBS region" refer to the amino acid sequence located between VR IV and VR V that governs the glycan binding specificity of the viral capsid. The locations of the GBS regions in various AAV VP1 amino acid sequences are herein described, and those from other AAV VP1 amino acid sequences are known in the art and/or may be routine identified.

The "GH loop" refers to a loop sequence that is flanked by β-strand G and β-strand H within the internal β-barrel of the capsid protein. The "GH loop" sequence comprises variable region VR IV through VR VIII, including the encompassed GBS sequence and all interspersed conserved backbone sequence from the donor. The locations of the GH loop regions in various AAV VP1 amino acid sequences are herein described and those from other AAV VP1 amino acid sequences may be routinely identified.

In regard to the herein described locations of the VR, GBS and GH loop regions, it is noted that the location of the N-terminal and/or C-terminal ends of those regions may vary by from up to 1 amino acid, 2 amino acids, 3 amino acids, 4 amino acids or 5 amino acids from the amino acid locations of those regions as they are explicitly described herein (particularly in Table 2). Novel capsid sequence comprising substituted VR, GBS and/or GH loop region(s) that vary from up to 5 amino acids on the N-terminal and/or C-terminal end as herein defined are encompassed by the present invention.

In one embodiment, the invention provides for an isolated, non-naturally occurring, chimeric adeno-associated virus (AAV) capsid protein, wherein the chimeric capsid protein comprises an amino acid sequence derived from a first AAV capsid sequence having at least one variable region substituted by a variable region derived from an at least second different AAV capsid sequence. In certain embodiments, the non-naturally occurring capsid protein is a VP1 capsid protein. In other embodiments, the chimeric capsid protein further comprises a GBS domain and/or a GH loop region from an AAV capsid sequence differing from the first recipient AAV capsid sequence. For example, the chimeric AAV capsid proteins of the invention have a backbone sequence derived from a first AAV capsid sequence (recipient) and at least one substituted variable region from a second different AAV capsid sequence (donor). In certain embodiments, the chimeric AAV capsid proteins of the present invention have one, two, three, four, five, six, seven, eight or all nine variable regions substituted by the respective variable region(s) from one or more donor AAV capsid sequence(s) that differ from the first recipient capsid sequence. In other embodiments, the AAV capsid proteins of the invention have a GBS domain or GH loop region sequence derived from a donor capsid sequence that differs from the recipient capsid sequence. Alternatively, the chimeric AAV capsids of the invention have at least one substitute variable region and a GBS from the same AAV capsid sequence which differs from the first AAV capsid sequence. The invention also provides non-naturally occurring AAV particles comprising any of the chimeric AAV capsid proteins described herein. Such AAVs may also comprise a heterologous transgene operably linked to a regulatory sequence controlling expression of the transgene in a host cell.

In addition, the invention provides for isolated AAV capsid proteins, wherein the capsid protein comprises an amino acid sequence from a first AAV capsid sequence which has two variable regions substituted with the respective variable regions from at least one AAV capsid sequence that differs from the first AAV capsid sequence, or least three variable regions substituted with the respective variable regions from at least one AAV capsid sequence that differs from the first AAV capsid sequence, or least four variable regions substituted with the respective variable regions from at least one AAV capsid sequence that differs from the first AAV capsid sequence, or least five variable regions substituted with the respective variable regions from at least one AAV capsid sequence that differs from the first AAV capsid sequence, or least six variable regions substituted with the respective variable regions from at least one AAV capsid sequence that differs from the first AAV capsid sequence, or least seven variable regions substituted with the respective variable regions from at least one AAV capsid sequence that differs from the first AAV capsid sequence, or least eight variable regions substituted with the respective variable regions from at least one AAV capsid sequence that differs from the first AAV capsid sequence, or all nine of the variable regions substituted with the respective variable regions from at least one AAV capsid sequence that differs from the first AAV capsid sequence. For example, the substituted variable region(s) are from the same AAV capsid sequence or the substituted variable regions are from two or more different AAV capsid sequences that differ from the first AAV capsid sequence. In addition, in any of these AAV capsid proteins of the invention, the GBS and/or the GH loop are also substituted and may be derived from any AAV donor capsid sequence that differs from the first AAV capsid sequence.

In any of the chimeric AAV capsids of the invention, the first/recipient AAV capsid sequence and the second/donor AAV capsid sequence can be any known or herein described AAV capsid sequence including, for example, capsid sequences associated with the following AAV sequences: AAV-1, AAV-2, AAV-3, AAV-3B, AAV-4, AAV-5, AAV-6, AAV-7, AAV-8, AAV-9, AAV-10, AAV-11, AAV-12, AAV-13, AAVbo, AAVmo, AAV6.2, AAVRH.8, AAV4.10, AAVanc80L65 or AAVanc110, or any of the other AAV serotypes or capsid sequences herein described. Production of pseudotyped rAAV is disclosed in, for example, WO 01/83692. Other types of rAAV variants, for example rAAV with capsid mutations, are also contemplated. See, for example, Marsic et al., *Molecular Therapy,* 22(11): 1900-1909 (2014).

In certain embodiments, the chimeric AAV capsid proteins of the invention may comprise the amino acid sequence of any one of SEQ ID NOS:90-157, each of which have at least one variable region from a donor AAV serotype swapped for the respective variable region(s) in the recipient backbone sequence.

In any of the chimeric AAV capsid proteins of the invention, the backbone sequence or the amino acid sequence from the first AAV capsid sequence derives from the amino acid sequence of any of SEQ ID NO:1-73. In addition, in any of the chimeric AAV capsid proteins of the invention, the donor sequence or the amino acid sequence from the second AAV serotype derives from the amino acid sequence of one or more variable regions, GBS domain and/or GH loop of any of SEQ ID NO:1-73.

In another embodiment, the invention provides for an isolated polynucleotide sequence comprising a nucleotide sequence encoding any of the engineered chimeric AAV capsid proteins of the invention. In addition, the invention provides for isolated AAV vectors comprising these polynucleotide sequences and AAV vectors comprising a polynucleotide sequence encoding any of the chimeric AAV capsid proteins of the invention. The invention also provides for compositions comprising these AAV vectors, including pharmaceutical compositions. The invention also provides for AAV virus comprising any of the herein described non-naturally occurring chimeric AAV capsid proteins.

The invention provides for methods of producing a recombinant adeno-associated virus (AAV) particle comprising the steps of: culturing a cell that has been transfected with any of the AAV vectors of the invention and recovering recombinant AAV particle from the supernatant of the transfected cell. In addition, the invention provides for viral particles comprising any of the viral vectors or capsid proteins of the invention and cells comprising these viral vectors.

One embodiment of the invention provides a method of producing any of the recombinant AAV described herein by culturing a viral production cell into which has been introduced a first nucleic acid vector having 5' and 3' AAV inverted terminal repeat sequences flanking a transgene having a heterologous gene operably linked to regulatory sequences that control expression of the heterologous gene in a host cell, and a second nucleic acid vector having AAV rep and cap nucleic acids sequences, wherein said cap nucleic acid sequence encodes an AAV capsid that is at least 95% identical to any of SEQ ID NOS:15-157; and recovering the AAV from the supernatant of the viral production cell culture. In another embodiment the viral production cell is an insect cell. In a preferred embodiment the insect cell is an Sf9 cell. In a further embodiment the first nucleic acid vector is introduced into the viral production cell by infection of the viral production cell by a baculovirus containing the first nucleic acid vector. In yet another embodiment the first and second nucleic acid vectors are introduced into the viral production cell by infection of the viral production cell by a first baculovirus containing the first nucleic acid vector and a second baculovirus containing the second nucleic acid vector. In further embodiments the invention AAV produced by the production methods provided herein.

In another embodiment, the invention provides for methods of treating a patient suffering from a disorder or disease comprising administering to the patient an effective amount of any of the AAV vectors or virus of the invention.

In a further embodiment, the invention provides for use of any of the AAV vectors or virus of the invention for preparation of a medicament for the treatment of a disorder or disease. The invention also provides for compositions comprising any of the AAV vectors or virus of the invention for the treatment of a disease or disorder.

In yet another embodiment, the disease or disorder in a subject is associated with abnormal activity of an endogenous protein. As used herein "endogenous protein" means a protein or gene product encoded by the genome of the subject suffering from the disease or disorder.

An "AAV virion" or "AAV viral particle" or "AAV vector particle" or "AAV virus" refers to a viral particle composed of at least one AAV capsid protein and an encapsidated polynucleotide AAV vector. If the particle comprises a heterologous polynucleotide (i.e. a polynucleotide other than a wild-type AAV genome such as a transgene to be delivered to a mammalian cell), it is typically referred to as an "AAV vector particle" or simply an "AAV vector". Thus, production of AAV vector particle necessarily includes production of AAV vector, as such a vector is contained within an AAV vector particle.

The invention also provides for cells comprising any of the AAV vectors of the invention, and viral particles produced by these cells of the invention.

The term "inverted terminal repeat (ITR)" as used herein refers to the art-recognized regions found at the 5' and 3' termini of the AAV genome which function in cis as origins of DNA replication and as packaging signals for the viral genome. AAV ITRs, together with the AAV rep coding region, provide for efficient excision and rescue from a plasmid vector, and integration of a nucleotide sequence interposed between two flanking ITRs into a host cell genome. Sequences of certain AAV-associated ITRs are disclosed by Yan et al., *J. Virol.* 79(1):364-379 (2005) which is herein incorporated by reference in its entirety.

The phrase "helper functions for generating a productive AAV infection" as used herein refers to AAV-derived coding sequences that can be expressed to provide AAV gene products that, in turn, function in trans for productive AAV replication. Thus, AAV helper functions include the rep and cap regions. The rep expression products have been shown to possess many functions, including, among others: recognition, binding and nicking of the AAV origin of DNA replication; DNA helicase activity; and modulation of transcription from AAV (or other heterologous) promoters. The cap expression products supply necessary packaging functions. AAV helper functions are used herein to complement AAV functions in trans that are missing from AAV vectors. Helper functions for generating a productive AAV infection also may include certain helper functions from baculovirus, herpes virus, adenovirus, or vaccinia virus.

In some embodiments, the viral construct comprises a nucleotide sequence encoding AAV rep and cap genes.

The term "AAV rep gene" as used herein refers to the art-recognized region of the AAV genome which encodes the replication proteins of the virus which are required to replicate the viral genome and to insert the viral genome into a host genome during latent infection. For a further description of the AAV rep coding region, see, e.g., Muzyczka et al., *Current Topics in Microbiol. and Immunol.* 158:97-129 (1992); Kotin et al., *Human Gene Therapy* 5:793-801 (1994), the disclosures of which are incorporated herein by reference in their entireties. The rep coding region, as used herein, can be derived from any viral serotype, such as the AAV serotypes described above. The region need not include all of the wild-type genes but may be altered, e.g., by the insertion, deletion or substitution of nucleotides, so long as the rep genes retain the desired functional characteristics when expressed in a suitable recipient cell.

The term "AAV cap gene" as used herein refers to the art-recognized region of the AAV genome which encodes the coat proteins of the virus which are required for packaging the viral genome. For a further description of the cap coding region, see, e.g., Muzyczka et al., *Current Topics in Microbiol. and Immunol.* 158:97-129 (1992); Kotin et al., *Human Gene Therapy* 5:793-801 (1994), the disclosures of which are incorporated herein by reference in their entireties. The AAV cap coding region, as used herein, can be derived from any AAV serotype, as described above. The region need not include all of the wild-type cap genes but may be altered, e.g., by the insertion, deletion or substitution of nucleotides, so long as the genes provide for sufficient packaging functions when present in a host cell along with an AAV vector.

The term "transfection" is used to refer to the uptake of foreign DNA by a cell. A cell has been "transfected" when exogenous DNA has been introduced inside the cell membrane. A number of transfection techniques are generally known in the art. See, e.g., Graham et al., *Virology* 52:456 (1973); Sambrook et al., *Molecular Cloning: A Laboratory Manual*, Cold Spring Harbor Laboratories, New York (1989); Davis et al., *Basic Methods in Molecular Biology*, Elsevier (1986); Chu et al., *Gene* 13:197 (1981), the disclosures of which are incorporated herein by reference in their entireties. Such techniques can be used to introduce one or more exogenous DNA moieties, such as a nucleotide integration vector and other nucleic acid molecules, into suitable host cells. The term captures chemical, electrical, and viral-mediated transfection procedures.

The viral construct is, in some embodiments, in the form of a baculoviral vector capable of productive transformation, transfection or infection in any cell type. In some embodiments, the viral construct comprises at least one nucleotide sequence encoding a heterologous protein.

In yet another aspect, described herein is an AAV particle produced by a method described herein. In some embodiments, the AAV particle comprises in its genome at least one nucleotide encoding a heterologous protein.

The term "heterologous proteins or peptides" refer to any protein that is not expressed by wild type AAV including tags such as hexahistidine, FLAG, myc, polyhistidine, or labels or immunogens, adjuvants, selection markers, therapeutic proteins or targeting proteins or peptides, to name a few.

Exemplary heterologous protein described herein includes, but is not limited to, β-globin, hemoglobin, tissue plasminogen activator, and coagulation factors; colony stimulating factors (CSF); interleukins, such as IL-1, IL-2, IL-3, IL-4, IL-5, IL-6, IL-7, IL-8, IL-9, etc.; growth factors, such as keratinocyte growth factor (KGF), stem cell factor (SCF), fibroblast growth factor (FGF, such as basic FGF and acidic FGF), hepatocyte growth factor (HGF), insulin-like growth factors (IGFs), bone morphogenetic protein (BMP), epidermal growth factor (EGF), growth differentiation factor-9 (GDF-9), hepatoma derived growth factor (HDGF), myostatin (GDF-8), nerve growth factor (NGF), neurotrophins, platelet-derived growth factor (PDGF), thrombopoietin (TPO), transforming growth factor alpha (TGF-α), transforming growth factor beta (TGF-β), and the like; soluble receptors, such as soluble TNF-α receptors, soluble interleukin receptors (e.g., soluble IL-1 receptors and soluble type II IL-1 receptors), soluble γ/Δ T cell receptors, ligand-binding fragments of a soluble receptor, and the like; enzymes, such as α-glucosidase, imiglucarase, β-glucocerebrosidase, and alglucerase; enzyme activators, such as tissue plasminogen activator; chemokines, such as 1P-10, monokine induced by interferon-gamma (Mig), Groa/IL-8, RANTES, MIP-1α, MIP-1β, MCP-1, PF-4, and the like; angiogenic agents, such as vascular endothelial growth factors (VEGFs, e.g., VEGF121, VEGF165, VEGF-C, VEGF-2), glioma-derived growth factor, angiogenin, angiogenin-2; and the like; anti-angiogenic agents, such as a soluble VEGF receptor; protein vaccine; neuroactive peptides, such as nerve growth factor (NGF), bradykinin, cholecystokinin, gastin, secretin, oxytocin, gonadotropin-releasing hormone, beta-endorphin, enkephalin, substance P, somatostatin, prolactin, galanin, growth hormone-releasing hormone, bombesin, dynorphin, warfarin, neurotensin, motilin, thyrotropin, neuropeptide Y, luteinizing hormone, calcitonin, insulin, glucagons, vasopressin, angiotensin II, thyrotropin-releasing hormone, vasoactive intestinal peptide, a sleep peptide, and the like; thrombolytic agents; atrial natriuretic peptide; relaxin; glial fibrillary acidic protein; follicle stimulating hormone (FSH); human alpha-1 antitrypsin; leukemia inhibitory factor (LIF); tissue factors, luteinizing hormone; macrophage activating factors; tumor necrosis factor (TNF); neutrophil chemotactic factor (NCF); tissue inhibitors of metalloproteinases; vasoactive intestinal peptide; angiogenin; angiotropin; fibrin; hirudin; IL-1 receptor antagonists; ciliary neurotrophic factor (CNTF); brain-derived neurotrophic factor (BDNF); neurotrophins 3 and 4/5 (NT-3 and 4/5); glial cell derived neurotrophic factor (GDNF); aromatic amino acid decarboxylase (AADC); Factor VIII, Factor IX, Factor X; dystrophin or nini-dystrophin; lysosomal acid lipase; phenylalanine hydroxylase (PAH); glycogen storage disease-related enzymes, such as glucose-6-phosphatase, acid maltase, glycogen debranching enzyme, muscle glycogen phosphorylase, liver glycogen phosphorylase, muscle phosphofructokinase, phosphorylase kinase, glucose transporter, aldolase A, β-enolase, glycogen synthase; and lysosomal enzymes.

DETAILED DESCRIPTION

The invention provides for novel AAV capsid proteins, nucleic acid encoding those capsid proteins and AAV virus comprising those novel capsid proteins. In some embodiments, the AAV capsid proteins were isolated and identified from various mammalian tissues. The amino acid sequences of the novel AAV capsid VP1 proteins are set out as SEQ ID NOS:15-89, and the locations of the associated VP2 and VP3 regions are disclosed herein. In addition, the invention provides for novel engineered chimeric AAV capsid proteins which have a backbone amino acid sequence derived from one AAV capsid sequence and fragments of capsid proteins from at least one other, different AAV capsid sequence, such as at least one VR, GBS and/or GH loop. The amino acid sequences of exemplary engineered chimeric AAV capsid VP1 proteins are set out as SEQ ID NOS:90-157.

AAV Vectors

As used herein, the term "AAV" is a standard abbreviation for adeno-associated virus. Adeno-associated virus is a single-stranded DNA parvovirus that grows only in cells in which certain functions are provided by a co-infecting helper virus. There are currently at least thirteen serotypes of AAV that have been characterized, as shown below in Table 1. General information and reviews of AAV can be found in, for example, Carter, *Handbook of Parvoviruses*, Vol. 1, pp. 169-228 (1989), and Berns, *Virology*, pp. 1743-1764, Raven Press, (New York, 1990). However, it is fully expected that these same principles will be applicable to additional AAV serotypes since it is well known that the various serotypes are quite closely related, both structurally and functionally, even at the genetic level. (See, for example, Blacklowe, pp. 165-174 of *Parvoviruses and Human Disease*, J. R. Pattison, ed. (1988); and Rose, *Comprehensive Virology* 3:1-61 (1974)). For example, all AAV serotypes apparently exhibit very similar replication properties mediated by homologous rep genes; and all bear three related capsid proteins such as those expressed in AAV6. The degree of relatedness is further suggested by heteroduplex analysis which reveals extensive cross-hybridization between serotypes along the length of the genome; and the presence of analogous self-annealing segments at the termini that correspond to "inverted terminal repeat sequences" (ITRs). The similar infectivity patterns also suggest that the replication functions in each serotype are under similar regulatory control.

An "AAV vector" as used herein refers to a vector comprising one or more polynucleotides of interest (or transgenes) that are flanked by AAV terminal repeat sequences (ITRs). Such AAV vectors can be replicated and packaged into infectious viral particles when present in a host cell that has been transfected with a vector encoding and expressing rep and cap gene products.

An "AAV virion" or "AAV viral particle" or "AAV vector particle" or "AAV virus" refers to a viral particle composed of at least one AAV capsid protein and an encapsidated polynucleotide AAV vector. If the particle comprises a heterologous polynucleotide (i.e. a polynucleotide other than a wild-type AAV genome such as a transgene to be delivered to a mammalian cell), it is typically referred to as an "AAV vector particle" or simply an "AAV vector". Thus, production of AAV vector particle necessarily includes production of AAV vector, as such a vector is contained within an AAV vector particle.

AAV "rep" and "cap" genes are genes encoding replication and encapsidation proteins, respectively. AAV rep and cap genes have been found in all AAV serotypes examined to date, and are described herein and in the references cited. In wild-type AAV, the rep and cap genes are generally found adjacent to each other in the viral genome (i.e., they are "coupled" together as adjoining or overlapping transcriptional units), and they are generally conserved among AAV serotypes. AAV rep and cap genes are also individually and collectively referred to as "AAV packaging genes." The AAV cap gene in accordance with the present invention encodes a Cap protein which is capable of packaging AAV vectors in the presence of rep and adeno helper function and is capable of binding target cellular receptors. In some embodiments, the AAV cap gene encodes a capsid protein having an amino acid sequence derived from a particular AAV serotype, for example the serotypes shown in Table 1.

TABLE 1

AAV serotypes

| AAV Serotype | Genbank Accession No. |
| --- | --- |
| AAV-1 | NC_002077.1 |
| AAV-2 | NC_001401.2 |
| AAV-3 | NC_001729.1 |
| AAV-3B | AF028705.1 |
| AAV-4 | NC_001829.1 |
| AAV-5 | NC_006152.1 |
| AAV-6 | AF028704.1 |
| AAV-7 | NC_006260.1 |
| AAV-8 | NC_006261.1 |
| AAV-9 | AX753250.1 |
| AAV-10 | AY631965.1 |
| AAV-11 | AY631966.1 |
| AAV-12 | DQ813647.1 |
| AAV-13 | EU285562.1 |

The AAV sequences employed for the production of AAV can be derived from the genome of any AAV serotype. Generally, the AAV serotypes have genomic sequences of significant homology at the amino acid and the nucleic acid levels, provide a similar set of genetic functions, produce virions which are essentially physically and functionally equivalent, and replicate and assemble by practically identical mechanisms. For the genomic sequence of AAV serotypes and a discussion of the genomic similarities see, for example, GenBank Accession number U89790; GenBank Accession number J01901; GenBank Accession number AF043303; GenBank Accession number AF085716; Chlorini et al., *J. Vir.* 71:6823-33(1997); Srivastava et al., *J. Vir.*

45:555-64 (1983); Chlorini et al., *J. Vir.* 73:1309-1319 (1999); Rutledge et al., *J. Vir.* 72:309-319 (1998); and Wu et al., *J. Vir.* 74: 8635-47 (2000).

The genomic organization of all known AAV serotypes is very similar. The genome of AAV is a linear, single-stranded DNA molecule that is less than about 5,000 nucleotides (nt) in length. Inverted terminal repeats (ITRs) flank the unique coding nucleotide sequences for the non-structural replication (Rep) proteins and the structural (VP) proteins. The VP proteins form the capsid. The terminal 145 nt are self-complementary and are organized so that an energetically stable intramolecular duplex forming a T-shaped hairpin may be formed. These hairpin structures function as an origin for viral DNA replication, serving as primers for the cellular DNA polymerase complex. The Rep genes encode the Rep proteins, Rep78, Rep68, Rep52, and Rep40. Rep78 and Rep68 are transcribed from the p5 promoter, and Rep 52 and Rep40 are transcribed from the p19 promoter. The cap genes encode the VP proteins, VP1, VP2, and VP3. The cap genes are transcribed from the p40 promoter.

In some embodiments, a nucleic acid sequence encoding an AAV capsid protein is operably linked to regulatory expression control sequences for expression in a specific cell type, such as Sf9 or HEK cells. Techniques known to one skilled in the art for expressing foreign genes in insect host cells or mammalian host cells can be used to practice the invention. Methodology for molecular engineering and expression of polypeptides in insect cells is described, for example, in Summers and Smith. *A Manual of Methods for Baculovirus Vectors and Insect Culture Procedures*, Texas Agricultural Experimental Station Bull. No. 7555, College Station, Tex. (1986); *Luckow.* 1991. In Prokop et al., *Cloning and Expression of Heterologous Genes in Insect Cells with Baculovirus Vectors' Recombinant DNA Technology and Applications,* 97-152 (1986); King, L. A. and R. D. Possee, *The baculovirus expression system*, Chapman and Hall, United Kingdom (1992); O'Reilly, D. R., L. K. Miller, V. A. Luckow, *Baculovirus Expression Vectors: A Laboratory Manual*, New York (1992); W. H. Freeman and Richardson, C. D., *Baculovirus Expression Protocols, Methods in Molecular Biology*, volume 39 (1995); U.S. Pat. No. 4,745, 051; US2003148506; and WO 03/074714. A particularly suitable promoter for transcription of a nucleotide sequence encoding an AAV capsid protein is e.g. the polyhedron promoter. However, other promoters that are active in insect cells are known in the art, e.g. the p10, p35 or IE-1 promoters and further promoters described in the above references are also contemplated.

Use of insect cells for expression of heterologous proteins is well documented, as are methods of introducing nucleic acids, such as vectors, e.g., insect-cell compatible vectors, into such cells and methods of maintaining such cells in culture. See, for example, *METHODS IN MOLECULAR BIOLOGY*, ed. Richard, Humana Press, N J (1995); O'Reilly et al., *BACULOVIRUS EXPRESSION VECTORS, A LABORATORY MANUAL*, Oxford Univ. Press (1994); Samulski et al., *J. Vir.* 63:3822-8 (1989); Kajigaya et al., *Proc. Nat'l. Acad. Sci. USA* 88:4646-50 (1991); Ruffing et al., *J. Vir.* 66:6922-30 (1992); Kirnbauer et al., *Vir.* 219:37-44 (1996); Zhao et al., Vir. 272:382-93 (2000); and Samulski et al., U.S. Pat. No. 6,204,059. In some embodiments, the nucleic acid construct encoding AAV in insect cells is an insect cell-compatible vector. An "insect cell-compatible vector" or "vector" as used herein refers to a nucleic acid molecule capable of productive transformation or transfection of an insect or insect cell. Exemplary biological vectors include plasmids, linear nucleic acid molecules, and recombinant viruses. Any vector can be employed as long as it is insect cell-compatible. The vector may integrate into the insect cell's genome but the presence of the vector in the insect cell need not be permanent and transient episomal vectors are also included. The vectors can be introduced by any means known, for example by chemical treatment of the cells, electroporation, or infection. In some embodiments, the vector is a baculovirus, a viral vector, or a plasmid. In a more preferred embodiment, the vector is a baculovirus, i.e. the construct is a baculoviral vector. Baculoviral vectors and methods for their use are described in the above cited references on molecular engineering of insect cells.

Baculoviruses are enveloped DNA viruses of arthropods, two members of which are well known expression vectors for producing recombinant proteins in cell cultures. Baculoviruses have circular double-stranded genomes (80-200 kbp) which can be engineered to allow the delivery of large genomic content to specific cells. The viruses used as a vector are generally *Autographa californica* multicapsid nucleopolyhedrovirus (AcMNPV) or *Bombyx mori* (Bm) NPV) (Kato et al., *Appl. Microbiol. Biotechnol.* 85(3):459-470 (2010)). Baculoviruses are commonly used for the infection of insect cells for the expression of recombinant proteins. In particular, expression of heterologous genes in insects can be accomplished as described in for instance U.S. Pat. No. 4,745,051; Friesen et al., *Curr. Top. Microbiol. Immunol.* 131:31-49. (1986); EP 127,839; EP 155,476; Miller et al., *Ann. Rev. of Microbiol.* 42: 177-199 (1988); Carbonell et al., *Gene* 73(2):409-18 (1988); Maeda et al., *Nature* 315(6020):592-4 (1985); Lebacq-Verheyden et al., *Mol. Cell. Biol.* 8(8):3129-35 (1988); Smith et al., *Proc. Natl. Acad. Sci. U.S.A.* 82(24):8404-8 (1985); Miyajima et al., *Gene* 58(2-3):273-81 (1987); and Martin et al., *DNA* 7(2):99-106 (1988). Numerous baculovirus strains and variants and corresponding permissive insect host cells that can be used for protein production are described in Luckow et al., *Nature Biotechnology* 6:47-55 (1988), and Maeda et al., *Nature* 315(6020):592-4 (1985).

Novel AAV Capsid Protein

In a first aspect, the invention provides for novel AAV capsid proteins that were isolated from various mammalian tissues. The novel AAV VP1 capsid proteins are provided as SEQ ID NOS:15-89 and the locations of the associated VP2 and VP3 regions are described herein. The invention also provides for polynucleotides comprising a nucleotide sequence encoding these novel AAV capsid proteins. The invention provides the amino acid sequences of the novel AAV capsid proteins including the engineered chimeric capsid proteins described herein (referred herein collectively as the "AAV capsid proteins of the invention"), and the nucleic acid sequences encoding the AAV capsid proteins of the invention. Also provided are fragments of these AAV capsid nucleic acid and amino acid sequences of the invention. Each of these sequences may be readily utilized in a variety of vector systems and host cells. Desirable fragments of the capsid VP1 proteins include VP2, VP3 and variable regions, the GBS domain and the GH loop, and polynucleotide sequences encoding these proteins. These fragments may be readily utilized in a variety of vector systems and host cells. Such fragments may be used alone, in combination with other AAV sequences or fragments, or in combination with elements from other AAV or non-AAV viral sequences. In one particularly desirable embodiment, a vector contains the AAV capsid sequences of the invention.

The AAV capsid sequences of the invention and fragments thereof are useful in production of rAAV, and are also useful as antisense delivery vectors, gene therapy vectors, or vaccine vectors. The invention further provides nucleic acid molecules, gene delivery vectors, and host cells which contain the novel AAV capsid sequences of the invention.

Suitable fragments can be determined using the information provided herein. Alignments are performed using any of a variety of publicly or commercially available Multiple Sequence Alignment Programs, such as "Clustal W", accessible through Web Servers on the internet. Alternatively, Vector NTI utilities are also used. There are also a number of algorithms known in the art which can be used to measure nucleotide sequence identity, including those contained in the programs described above. As another example, polynucleotide sequences can be compared using FASTA, a program in GCG Version 6.1. FASTA provides alignments and percent sequence identity of the regions of the best overlap between the query and search sequences. For instance, percent sequence identity between nucleic acid sequences can be determined using FASTA with its default parameters (a word size of 6 and the NOPAM factor for the scoring matrix) as provided in GCG Version 6.1, herein incorporated by reference. Similar programs are available for amino acid sequences, e.g., the "Clustal X" program. Additional sequence alignment tools that can be used are provided by (protein sequence alignment; (EMBOSS Needle—ebi.ac.uk rools/psa/emboss needle/)) and (nucleic acid alignment; EMBOSS Needle—ebi.ac.ubTools/psa emboss . . . needle/nucleotide.html)). Generally, any of these programs are used at default settings, although one of skill in the art can alter these settings as needed. Alternatively, one of skill in the art can utilize another algorithm or computer program which provides at least the level of identity or alignment as that provided by the referenced algorithms and programs.

The terms "substantial identity", "substantial homology" or "substantial similarity," when referring to a nucleic acid, or fragment thereof, indicates that, when optimally aligned with appropriate nucleotide insertions or deletions with another nucleic acid (or its complementary strand), there is nucleotide sequence identity in at least about 95 to 99% of the aligned sequences such as 95% identity, 96% identity, 97% identity, 98% identity and 99% identity. Preferably, the homology is over the full-length of the two sequences being compared, or an open reading frame thereof, or another suitable fragment which is at least 15 nucleotides in length. Examples of suitable fragments are described herein. Also included in the nucleic acid sequences of the invention are natural variants and engineered modifications of the nucleic acids encoding the AAV capsids of the invention and its complementary strand. Such modifications include, for example, labels which are known in the art, methylation, and substitution of one or more of the naturally occurring nucleotides with a degenerate nucleotide.

The terms "substantial identity", "substantial homology" or "substantial similarity," when referring to amino acids or fragments thereof, indicates that, when optimally aligned with appropriate amino acid insertions or deletions with another amino acid (or its complementary strand), there is amino acid sequence identity in at least about 95 to 99% of the aligned sequences such as 95% identity, 96% identity, 97% identity, 98% identity and 99% identity. Preferably, the homology is over the full-length of the two sequences being compared, or a protein thereof, e.g., a cap protein, a rep protein, or a fragment thereof which is at least 8 amino acids, or more desirably, at least 15 amino acids in length. Examples of suitable fragments are described herein.

By the term "highly conserved" is meant at least 80% identity, preferably at least 90% identity, and more preferably, over 97% identity. Identity is readily determined by one of skill in the art by resort to algorithms and computer programs known by those of skill in the art.

The term "percent sequence identity" or "identical" in the context of nucleic acid sequences or amino acid sequences refers to the residues in the two sequences which are the same when aligned for maximum correspondence. The length of sequence identity comparison may be over the full-length of the two sequences being compared, the full-length of a gene coding sequence, or a fragment of at least about 500 to 5000 nucleotides, is desired. However, identity among smaller fragments, e.g. of at least about nine nucleotides, usually at least about 20 to 24 nucleotides, at least about 28 to 32 nucleotides, at least about 36 or more nucleotides, may also be desired. Similarly, "percent sequence identity" may be readily determined for amino acid sequences, over the full-length of a protein, or a fragment thereof. Suitably, a fragment is at least about 8 amino acids in length, and may be up to about 700 amino acids. Examples of suitable fragments are described herein.

As described herein, the vectors of the invention containing or comprising the AAV capsid proteins of the invention are particularly well-suited for use in applications in which the neutralizing antibodies diminish the effectiveness of other AAV serotype based vectors, as well as other viral vectors. The rAAV vectors of the invention are particularly advantageous in rAAV re-administration and repeat gene therapy.

Also included within the invention are fragments of the nucleic acids encoding the AAV capsid proteins of the invention, their complementary strand, cDNA and RNA complementary thereto. Suitable fragments are at least 15 nucleotides in length, and encompass functional fragments, i.e., fragments which are of biological interest. Such fragments include the sequences encoding the three variable proteins (VP) of the capsid which are alternative splice variants: VP1, VP2 and VP3. Other suitable fragments of the nucleic acids encoding the AAV capsids of the invention include the fragment which contains the start codon for the capsid protein, and the fragments encoding the variable regions of the VP1 capsid protein, which are described herein.

The invention is not limited to the AAV capsid amino acid sequences, peptides and proteins expressed from the AAV nucleic acid sequences of the invention and encompasses amino acid sequences, peptides and proteins generated by other methods known in the art, including, e.g., by chemical synthesis, by other synthetic techniques, or by other methods. For example, the sequences of any of the capsids described herein can be readily generated using a variety of techniques.

Suitable production techniques are well known to those of skill in the art. See, e.g., Sambrook et al, *Molecular Cloning: A Laboratory Manual*, Cold Spring Harbor Press (Cold Spring Harbor, N.Y.). Alternatively, peptides can also be synthesized by the well-known solid phase peptide synthesis methods (Merrifield, *J. Am. Chem. Soc.*, 85:2149 (1962); Stewart and Young, *Solid Phase Peptide Synthesis* Freeman, (San Francisco, 1969) pp. 27-62. These and other suitable production methods are within the knowledge of those of skill in the art and are not a limitation of the present invention.

The AAV capsid is composed of three proteins, VP1, VP2 and VP3, which are alternative splice variants. The full-length capsid sequence is referred to as VP1 which encompasses the spliced variants referred to as VP2 and VP3. The invention also provides for other functional fragments of the AAV capsid proteins of the invention. Other desirable fragments of the capsid protein include the variable regions (VR), the constant regions which are located between the variable regions, the GBS domain, and the GH loop. Other desirable fragments of the capsid protein include the HPV themselves.

An algorithm has been developed to determine areas of sequence divergence in AAV2. (Chiorini et al, *J. Virol,* 73:1309-19 (1999); Rutledge et al, *J. Virol.,* 72:309-319 (1998)). Using this algorithm and/or the alignment techniques described herein, the VR of the novel AAV capsid sequences are determined. Using the alignment provided herein performed using the Clustal X program at default settings, or using other commercially or publicly available alignment programs at default settings, one of skill in the art can readily determine corresponding fragments of the novel AAV capsids of the invention.

Suitably, fragments of an AAV capsid protein are at least 8 amino acids in length, or at least 9 amino acids in length, or at least 10 amino acids in length, or least 20 amino acids in length, or 30 amino acids in length or at least 50 amino acids in length, or at least 75 amino acids in length, or at least 100 amino acids in length or 200 amino acids in length or 250 amino acids in length or 300 amino acids in length or 350 amino acids in length or 400 amino acids in length. However, fragments of other desired lengths may be readily utilized. All fragments of the invention retain biological activity of a capsid AAV protein. Such fragments may be produced recombinantly or by other suitable means, e.g., chemical synthesis.

The sequences, proteins, and fragments of the invention may be produced by any suitable means, including recombinant production, chemical synthesis, or other synthetic means. Such production methods are within the knowledge of those of skill in the art and are not a limitation of the present invention.

In addition to including the nucleic acid sequences provided in the Sequence Listing, the present invention includes nucleic acid molecules and sequences which are designed to express the amino acid sequences, proteins and peptides of the AAV capsid proteins of the invention. Thus, the invention includes nucleic acid sequences which encode the following AAV capsid amino acid sequences and artificial AAV capsid proteins generated using these sequences and/or unique fragments thereof.

Artificial capsid or engineered capsid proteins may be generated by any suitable technique, using a AAV capsid protein sequence of the invention (e.g., a fragment of a VP1 capsid protein) in combination with heterologous sequences which may be obtained from another AAV serotype (known or novel), non-contiguous portions of the same AAV serotype, from a non-AAV viral source, or from a non-viral source. An artificial AAV serotype may be, without limitation, a chimeric AAV capsid, a recombinant AAV capsid, or a "humanized" AAV capsid.

Production of AAV with the Capsid Proteins of the Invention

The invention encompasses AAV capsid protein sequences and the nucleic acids encoding these proteins of which are free of DNA and/or cellular material which these viruses are associated in nature. In another aspect, the present invention provides molecules which utilize the novel AAV sequences of the invention, including fragments thereof, for production of molecules useful in delivery of a heterologous gene or other nucleic acid sequences to a target cell.

In another aspect, the present invention provides molecules which utilize the AAV capsid protein sequences of the invention, including fragments thereof, for production of viral vectors useful in delivery of a heterologous gene or other nucleic acid sequences to a target cell.

The molecules of the invention which contain AAV capsid nucleic acid sequences include any genetic element (vector) which may be delivered to a host cell, e.g., naked DNA, a plasmid, phage, transposon, cosmid, episome, a protein in a non-viral delivery vehicle (e.g., a lipid-based carrier), virus, etc. which transfer the sequences carried thereon. The selected vector may be delivered by any suitable method, including transfection, electroporation, liposome delivery, membrane fusion techniques, high velocity DNA-coated pellets, viral infection and protoplast fusion. The methods used to construct any embodiment of this invention are known to those with skill in nucleic acid manipulation and include genetic engineering, recombinant engineering, and synthetic techniques. See, e.g., Sambrook et al, *Molecular Cloning: A Laboratory Manual,* Cold Spring Harbor Press, Cold Spring Harbor, N.Y.

In one embodiment, the vectors of the invention contain, at a minimum, sequences encoding the AAV capsid of the invention or a fragment thereof. In another embodiment, the vectors of the invention contain, at a minimum, sequences encoding an AAV rep protein or a fragment thereof. Optionally, such vectors may contain both AAV cap and rep proteins. In vectors in which both AAV rep and cap are provided, the AAV rep and AAV cap sequences can both be of the same AAV serotype origin. Alternatively, the present invention provides vectors in which the rep sequences are from an AAV serotype which differs from that which is providing the cap sequences. In one embodiment, the rep and cap sequences are expressed from separate sources (e.g., separate vectors, or a host cell and a vector). In another embodiment, these rep sequences are fused in frame to cap sequences of a different AAV serotype to form a chimeric AAV vector. Optionally, the vectors of the invention further contain a minigene comprising a selected transgene which is flanked by AAV 5' ITR and AAV 3' ITR.

Thus, in one embodiment, the vectors described herein contain nucleic acid sequences encoding an intact AAV capsid protein of any one of amino acid sequences SEQ ID NO: 1-73. Alternatively, these vectors contain sequences encoding artificial capsids which contain one or more fragments of the capsid fused to heterologous AAV or non-AAV capsid proteins (or fragments thereof). These artificial capsid proteins are selected from non-contiguous portions of the any of the AAV capsid proteins of the invention or from capsids of other AAV serotypes. In another example, it may be desirable to alter the start codon of the VP3 protein to GTG. Alternatively, the rAAV may contain one or more of the variable regions of one or more of the AAV capsid proteins of the invention, or other fragments. These modifications may be to increase expression, yield, and/or to improve purification in the selected expression systems, or for another desired purpose (e.g., to change tropism or alter neutralizing antibody epitopes).

The vectors described herein, e.g., a plasmid, are useful for a variety of purposes, but are particularly well suited for use in production of a rAAV containing a capsid comprising AAV sequences or a fragment thereof. These vectors, including rAAV, their elements, construction, and uses are described in detail herein.

VP1 Amino Acid Sequences of Known AAV Capsid Proteins

The invention also provides for engineered chimeric AAV capsid proteins (and AAV comprising those capsid proteins) in which one or more variable region(s), the GBS region and/or the GH loop in a backbone (or recipient) capsid protein sequence are substituted with one or more variable region(s), GBS region and/or GH loop from a different AAV capsid sequence donor. The recipient and donor sequences may derive from any previously known AAV serotype or capsid sequence, or any novel AAV capsid sequence described herein. The novel, engineered AAV capsid proteins of the invention are generated by swapping at least one variable region, GBS region or GH loop region from one capsid sequence for the respective region(s) in a recipient capsid sequence. In this regard, it is noted that one, two, three, four, five, six, seven, eight or all nine VRs in a recipient VP1 capsid sequence can be replaced by the respective region(s) from one or more different VP1 capsid sequence. Any and all of the various combinations of engineered, chimeric AAV capsid sequences that can be produced by the VR region swapping method described herein (and all associated AAV virus comprising those chimeric capsid sequences) are contemplated by this invention.

The VP1 sequence of AAVbo is set out as SEQ ID NO:1 and the locations of the associated variable regions and GBS and GH loop regions are defined in Table 2 below.

MSFVDHPPDWLESIGDGFREFLGLEAGPPKPKANQQKQDNARGLVLPGYKY
LGPGNGLDKGDPVNFADEVAREHDLSYQKQLEAGDNPYLKYNHADAEFQEK
LASDTSFGGNLGKAVFQAKKRILEPLGLVETPDKTAPAAKKRPLEQSPQEP
DSSSGVGKKGKQPARKRLNFDDEPGAGDGPPPEGPSSGAMSTETEMRAAAG
GNGGDAGQGAEGVGNASGDWHCDSTWSESHVTTTSTRTWVLPTYNNHLYLR
LGSSNASDTFNGFSTPWGYFDFNRFHCHFSPRDWQRLINNHWGLRPKSMQV
RIFNIQVKEVTTSNGETTVSNNLTSTVQIFADSTYELPYVMDAGQEGSLPP
FPNDVFMVPQYGYCGLVTGGSSQNQTDRNAFYCLEYFPSQMLRTGNNFEMV
YKFENVPFHSMYAHSQSLDRLMNPLLDQYLWELQSTTSGGTLNQGNSATNF
AKLTKTNFSGYRKNWLPGPMMKQQRFSKTASQNYKIPQGRNNSLLHYETRT
TLDGRWSNFAPGTAMATAANDATDFSQAQLIFAGPNITGNTTTDANNLMFT
SEDELRATNPRDTDLFGHLATNQQNATTVPTVDDVDGVGVYPGMVWQDRDI
YYQGPIWAKIPHTDGHFHPSPLIGGFGLKSPPPQIFIKNTPVPANPATTFS
PARINSFITQYSTGQVAVKIEWEIQKERSKRWNPEVQFTSNYGAQDSLLWA
PDNAGAYKEPRAIGSRYLTNHL

The VP1 sequence of AAVmo is set out as SEQ ID NO:2 and the locations of the associated variable regions and GBS and GH loop regions are defined in Table 2 below.

MSFFDWLGKQYAQGAAEFWDLKSGPPAPKKARKDGSAGFNFPGHKYLGPGN
SLDRGDPVDADDAAAQKHDQSYQEQLEAGDNPYLKYNHADREFQEALKDDT
SFEGNLARGLFEAKKLVAEPLGLVEPELAPPSGRKRPVQSSQESGYSSSQD
KRPNLDVDEEDREFAAAAAETETGSAPPTGNLGPGTMAGGGSAPIDOGSYG
ADGVGNASGDWHCDSTWLDNCVITRTTRTWNLPTYNNHIYKRLNGTTSGDQ
SYFGFSTPWGYFDFNRFHCHFSPRDWQRLINNNWGLRPKSLRFKIFNIQVK
EVTTQDSTKIISNNLTSTVQVFADTEYQLPYVIGSAHEGCLPPFPADVFML
PQYGYCTRQDGNSNNPTPRSAFYCLEYFPSKMLRTGNSFEFTYNFEKVPFH
SMWAHNQSLDRLMNPLIDQYLYYLDVTSSTGFTYQKGVHTNLPEQERNWLP
GPGIRNQAWFNSATGNNPLTGTWQYSNKYVLENRASKIAPGPAMGIESTKF
DGNGIIFSKEYITNVNTANPNQVNITRETEINSTNPLAGGSLGAHANNSQN
TTTAPTLDHTNVMGVFPGSVWQDRDIYLQGQIWAKIPHTDGHFHPSPLMGG
FGLKNPPPQILIKNTPVPADPPTEFNANKISSFITQYSTGQVTVEMEWELQ
KETSKRWNPEIQYSDDSSSTSGSILHFAPDDVGNYKEFRSIGTRYLTRPL

The VP1 sequence of AAV2 is set out as SEQ ID NO:3 and the locations of the associated variable regions and GBS and GH loop regions are defined in Table 2 below.

MAADGYLPDWLEDTLSEGIRQWWKLKPGPPPPKPAERHKDDSRGLVLPGYK
YLGPFNGLDKGEPVNEADAAALEHDKAYDRQLDSGDNPYLKYNHADAEFQE
RLKEDTSFGGNLGRAVFQAKKRVLEPLGLVEEPVKTAPGKKRPVEHSPVEP
DSSSGTGKAGQQPARKRLNFGQTGDADSVPDPQPLGQPPAAPSGLGTNTMA
TGSGAPMADNNEGADGVGNSSGNWHCDSTWMGDRVITTSTRTWALPTYNNH
LYKQISSQSGASNDNHYFGYSTPWGYFDFNRFHCHFSPRDWQRLINNNWGF
RPKRLNFKLFNIQVKEVTQNDGTTTIANNLTSTVQVFTDSEYQLPYVLGSA
HQGCLPPFPADVFMVPQYGYLTLNNGSQAVGRSSFYCLEYFPSQMLRTGNN
FTFSYTFEDVPFHSSYAHSQSLDRLMNPLIDQYLYYLSRTNTPSGTTTQSR
LQFSQAGASDIRDQSRNWLPGPCYRQQRVSKTSADNNNSEYSWTGATKYHL
NGRDSLVNPGPAMASHKDDEEKFFPQSGVLIFGKQGSEKTNVDIEKVMITD
EEEIRTTNPVATEQYGSVSTNLQRGNRQAATADVNTQGVLPGMVWQDRDVY
LQGPIWAKIPHTDGHFHPSPLMGGFGLKHPPPQILIKNTPVPANPSTTFSA
AKFASFITQYSTGQVSVEIEWELQKENSKRWNPEIQYTSNYNKSVNVDFTV
DTNGVYSEPRPIGTRYLTRNL

The VP1 sequence of AAV4 is set out as SEQ ID NO:4 and the locations of the associated variable regions and GBS and GH loop regions are defined in Table 2 below.

MTDGYLPDWLEDNLSEGVREWWALQPGAPKPKANQQHQDNARGLVLPGYKY
LGPGNGLDKGEPVNAADAAALEHDKAYDQQLKAGDNPYLKYNHADAEFQQR
LQGDTSFGGNLGRAVFQAKKRVLEPLGLVEQAGETAPGKKRPLIESPQQPD
SSTGIGKKGKQPAKKKLVFEDETGAGDGPPEGSTSGAMSDDSEMRAAAGGA
AVEGGQGADGVGNASGDWHCDSTWSEGHVTTTSTRTWVLPTYNNHLYKRLG
ESLQSNTYNGFSTPWGYFDFNRFHCHFSPRDWQRLINNNWGMRPKAMRVKI
FNIQVKEVTTSNGETTVANNLTSTVQIFADSSYELPYVMDAGQEGSLPPFP
NDVFMVPQYGYCGLVTGNTSQQQTDRNAFYCLEYFPSQMLRTGNNFEITYS
FEKVPFHSMYAHSQSLDRLMNPLIDQYLWGLQSTTTGTTLNAGTATTNFTK
LRPTNFSNFKKNWLPGPSIKQQGFSKTANQNYKIPATGSDSLIKYETHSTL
DGRWSALTPGPPMATAGPADSKFSNSQLIFAGPKQNGNTATVPGTLIFTSE
EELAATNATDTDMWGNLPGGDQSNSNLPTVDRLTALGAVPGMVWQNRDIYY
QGPIWAKIPHTDGHFHPSPLIGGFGLKHPPPQIFIKNTPVPANPATTFSST
PVNSFITQYSTGQVSVQIDWEIQKERSKRWNPEVQFTSNYGQQNSLLWAPD
AAGKYTEPRAIGTRYLTHHL

The VP1 sequence of AAV5 is set out as SEQ ID NO:5 and the locations of the associated variable regions and GBS and GH loop regions are defined in Table 2 below.

MSFVDHPPDWLEEVGEGLREFLGLEAGPPKPKPNQQHQDQARGLVLPGYNY
LGPGNGLDRGEPVNRADEVAREHDISYNEQLEAGDNPYLKYNHADAEFQEK
LADDTSFGGNLGKAVFQAKKRVLEPFGLVEEGAKTAPTGKRIDDHFPKRKK
ARTEEDSKPSTSSDAEAGPSGSQQLQIPAQPASSLGADTMSAGGGGPLGDN
NQGADGVGNASGDWHCDSTWMGDRVVTKSTRTWVLPSYNNHQYREIKSGSV
DGSNANAYFGYSTPWGYFDFNRFHSHWSPRDWQRLINNYWGFRPRSLRVKI
FNIQVKEVTVQDSTTTIANNLTSTVQVFTDDDYQLPYVVGNGTEGCLPAFP
PQVFTLPQYGYATLNRDNTENPTERSSFFCLEYFPSKMLRTGNNFEFTYNF
EEVPFHSSFAPSQNLFKLANPLVDQYLYRFVSTNNTGGVQFNKNLAGRYAN
TYKNWFPGPMGRTQGWNLGSGVNRASVSAFATTNRMELEGASYQVPPQPNG
MTNNLQGSNTYALENTMIFNSQPANPGTTATYLEGNMLITSESETQPVNRV
AYNVGGQMATNNQSSTTAPATGTYNLQEIVPGSVWMERDVYLQGPIWAKIP
ETGAHFHPSPANGGFGLKHPPMMLIKNTPVPGNITSFSDVPVSSFITQYS
TGQVTVEMEWELKKENSKRWNPEIQYTNNYNDPQFVDFAPDSTGEYRTTRP
IGTRYLTRPL

The VP1 sequence of AAV6 is set out as SEQ ID NO:6 and the locations of the associated variable regions and GBS and GH loop regions are defined in Table 2 below.

MAADGYLPDWLEDNLSEGIREWWDLKPGAPKPKANQQKQDDGRGLVLPGYK
YLGPFNGLDKGEPVNAADAAALEHDKAYDQQLKAGDNPYLRYNHADAEFQE
RLQEDTSFGGNLGRAVFQAKKRVLEPFGLVEEGAKTAPGKKRPVEQSPQEP
DSSSGIGKTGQQPAKKRLNFGQTGDSESVPDPQPLGEPPATPAAVGPTTMA
SGGGAPMADNNEGADGVGNASGNWHCDSTWLGDRVITTSTRTWALPTYNNH
LYKQISSASTGASNDNHYFGYSTPWGYFDFNRFHCHFSPRDWQRLINNNWG
FRPKRLNFKLFNIQVKEVTTNDGVTTIANNLTSTVQVFSDSEYQLPYVLGS
AHQGCLPPFPADVFMIPQYGYLTLNNGSQAVGRSSFYCLEYFPSQMLRTGN
NFTFSYTFEDVPFHSSYAHSQSLDRLMNPLIDQYLYYLNRTQNQSGSAQNK
DLLFSRGSPAGMSVQPKNWLPGPCYRQQRVSKTKTDNNNSNFTWTGASKYN
LNGRESIINPGTAMASHKDDKDKFFPMSGVMIFGKESAGASNTALDNVMIT
DEEEIKATNPVATERFGTVAVNLQSSSTDPATGQVHVMGALPGMVWQDRDV
YLQGPIWAKIPHTDGHFHPSPLMGGFGLKHPPPQILIKNTPVPANPPAEFS
ATKFASFITQYSTGQVSVEIEWELQKENSKRWNPEVQYTSNYAKSANVDFT
VONNGLYTEPRPIGTRYLTRPL

The VP1 sequence of AAV6.2 is set out as SEQ ID NO:7 and the locations of the associated variable regions and GBS and GH loop regions are defined in Table 2 below.

MAADGYLPDWLEDNLSEGIREWWDLKPGAPKPKANQQKQDDGRGLVLPGYK
YLGPFNGLDKGEPVNAADAAALEHDKAYDQQLKAGDNPYLRYNHADAEFQE
RLQEDTSFGGNLGRAVFQAKKRVLEPLGLVEEGAKTAPGKKRPVEQSPQEP
DSSSGIGKTGQQPAKKRLNFGQTGDSESVPDPQPLGEPPATPAAVGPTTMA
SGGGAPMADNNEGADGVGNASGNWHCDSTWLGDRVITTSTRTWALPTYNNH
LYKQISSASTGASNDNHYFGYSTPWGYFDFNRFHCHFSPRDWQRLINNNWG
FRPKRLNFKLFNIQVKEVTTNDGVTTIANNLTSTVQVFSDSEYQLPYVLGS
AHQGCLPPFPADVFMIPQYGYLTLNNGSQAVGRSSFYCLEYFPSQMLRTGN
NFTFSYTFEDVPFHSSYAHSQSLDRLMNPLIDQYLYYLNRTQNQSGSAQNK
DLLFSRGSPAGMSVQPKNWLPGPCYRQQRVSKTKTDNNNSNFTWTGASKYN
LNGRESIINPGTAMASHKDDKDKFFPMSGVMIFGKESAGASNTALDNVMIT
DEEEIKATNPVATERFGTVAVNLQSSSTDPATGQVHVMGALPGMVWQDRDV
YLQGPIWAKIPHTDGHFHPSPLMGGFGLKHPPPQILIKNTPVPANPPAEFS
ATKFASFITQYSTGQVSVEIEWELQKENSKRWNPEVQYTSNYAKSANVDFT
VONNGLYTEPRPIGTRYLTRPL

The VP1 sequence of AAV7 is set out as SEQ ID NO:8 and the locations of the associated variable regions and GBS and GH loop regions are defined in Table 2 below.

MAADGYLPDWLEDNLSEGIREWWDLKPGAPKPKANQQKQDNGRGLVLPGY
KYLGPFNGLDKGEPVNAADAAALEHDKAYDQQLKAGDNPYLRYNHADAEF
QERLQEDTSFGGNLGRAVFQAKKRVLEPLGLVEEGAKTAPAKKRPVEPSP
QRSPDSSTGIGKKGQQPARKRLNFGQTGDSESVPDPQPLGEPPAAPSSVG
SGTVAAGGGAPMADNNEGADGVGNASGNWHCDSTWLGDRVITTSTRTWAL
PTYNNHLYKQISSETAGSTNDNTYFGYSTPWGYFDFNRFHCHFSPRDWQR
LINNNWGFRPKKLRFKLFNIQVKEVTTNDGVTTIANNLTSTIQVFSDSEY
QLPYVLGSAHQGCLPPFPADVFMIPQYGYLTLNNGSQSVGRSSFYCLEYF
PSQMLRTGNNFEFSYSFEDVPFHSSYAHSQSLDRLMNPLIDQYLYYLART
QSNPGGTAGNRELQFYQGGPSTMAEQAKNWLPGPCFRQQRVSKTLDQNNN
SNFAWTGATKYHLNGRNSLVNPGVAMATHKDDEDRFFPSSGVLIFGKTGA
TNKTTLENVLMTNEEEIRPTNPVATEEYGIVSSNLQAANTAAQTQVVNNQ
GALPGMVWQNRDVYLQGPIWAKIPHTDGNFHPSPLMGGFGLKHPPPQILI
KNTPVPANPPEVFTPAKFASFITQYSTGQVSVEIEWELQKENSKRWNPEI
QYTSNFEKQTGVDFAVDSQGVYSEPRPIGTRYLTRNL

The VP1 sequence of AAV8 is set out as SEQ ID NO:9 and the locations of the associated variable regions and GBS and GH loop regions are defined in Table 2 below.

MAADGYLPDWLEDNLSEGIREWWALKPGAPKPKANQQKQDDGRGLVLPGY
KYLGPFNGLDKGEPVNAADAAALEHDKAYDQQLQAGDNPYLRYNHADAEF
QERLQEDTSFGGNLGRAVFQAKKRVLEPLGLVEEGAKTAPGKKRPVEPSP
QRSPDSSTGIGKKGQQPARKRLNFGQTGDSESVPDPQPLGEPPAAPSGVG
PNTMAAGGGAPMADNNEGADGVGSSSGNWHCDSTWLGDRVITTSTRTWAL
PTYNNHLYKQISNGTSGGATNDNTYFGYSTPWGYFDFNRFHCHFSPRDWQ
RLINNNWGFRPKRLSFKLFNIQVKEVTQNEGTKTIANNLTSTIQVFTDSE

-continued

YQLPYVLGSAHQGCLPPFPADVFMIPQYGYLTLNNGSQAVGRSSFYCLEY

FPSQMLRTGNNFQFTYTFEDVPFHSSYAHSQSLDRLMNPLIDQYLYYLSR

TQTTGGTANTQTLGFSQGGPNTMANQAKNWLPGPCYRQQRVSTTTGQNNN

SNFAWTAGTKYHLNGRNSLANPGIAMATHKDDEERFFPSNGILIFGKQNA

ARDNADYSDVMLTSEEEIKTTNPVATEEYGIVADNLQQQNTAPQIGTVNS

QGALPGMVWQNRDVYLQGPIWAKIPHTDGNFHPSPLMGGFGLKHPPPQIL

IKNTPVPADPPTTFNQSKLNSFITQYSTGQVSVEIEWELQKENSKRWNPE

IQYTSNYYKSTSVDFAVNTEGVYSEPRPIGTRYLTRNL

The VP1 sequence of AAV9 is set out as SEQ ID NO:10 and the locations of the associated variable regions and GBS and GH loop regions are defined in Table 2 below.

MAADGYLPDWLEDNLSEGIREWWALKPGAPQPKANQQHQDNARGLVLPGY

KYLGPGNGLDKGEPVNAADAAALEHDKAYDQQLKAGDNPYLKYNHADAEF

QERLKEDTSFGGNLGRAVFQAKKRLLEPLGLVEEAAKTAPGKKRPVEQSP

QEPDSSAGIGKSGAQPAKKRLNFGQTGDTESVPDPQPIGEPPAAPSGVGS

LTMASGGGAPVADNNEGADGVGSSSGNWHCDSQWLGDRVITTSTRTWALP

TYNNHLYKQISNSTSGGSSNDNAYFGYSTPWGYFDFNRFHCHFSPRDWQR

LINNNWGFRPKRLNFKLFNIQVKEVTDNNGVKTIANNLTSTVQVFTDSDY

QLPYVLGSAHEGCLPPFPADVFMIPQYGYLTLNDGSQAVGRSSFYCLEYF

PSQMLRTGNNFQFSYEFENVPFHSSYAHSQSLDRLMNPLIDQYLYYLSKT

INGSGQNQQTLKFSVAGPSNMAVQGRNYIPGPSYRQQRVSTTVTQNNNSE

FAWPGASSWALNGRNSLMNPGPAMASHKEGEDRFFPLSGSLIFGKQGTGR

DNVDADKVMITNEEEIKTTNPVATESYGQVATNHQSAQAQAQTGWVQNQG

ILPGMVWQDRDVYLQGPIWAKIPHTDGNFHPSPLMGGFGMKHPPPQILIK

NTPVPADPPTAFNKDKLNSFITQYSTGQVSVEIEWELQKENSKRWNPEIQ

YTSNYYKSNNVEFAVNTEGVYSEPRPIGTRYLTRNL

The VP1 sequence of AAVrh.8 is set out as SEQ ID NO:11 and the locations of the associated variable regions and GBS and GH loop regions are defined in Table 2 below.

MAADGYLPDWLEDNLSEGIREWWDLKPGAPKPKANQQKQDDGRGLVLPGY

KYLGPFNGLDKGEPVNAADAAALEHDKAYDQQLKAGDNPYLRYNHADAEF

QERLQEDTSFGGNLGRAVFQAKKRVLEPLGLVEEGAKTAPGKKRPVEQSP

QEPDSSSGIGKTGQQPAKKRLNFGQTGDSESVPDPQPLGEPPAAPSGLGP

NTMASGGGAPMADNNEGADGVGNSSGNWHCDSTWLGDRVITTSTRTWALP

TYNNHLYKQISNGTSGGSTNDNTYFGYSTPWGYFDFNRFHCHFSPRDWQR

LINNNWGFRPKRLNFKLFNIQVKEVTTNEGTKTIANNLTSTVQVFTDSEY

QLPYVLGSAHQGCLPPFPADVFMVPQYGYLTLNNGSQALGRSSFYCLEYF

PSQMLRTGNNFQFSYTFEDVPFHSSYAHSQSLDRLMNPLIDQYLYYLVRT

QTTGTGGTQTLAFSQAGPSSMANQARNWVPGPCYRQQRVSTTTNQNNNSN

FAWTGAAKFKLNGRDSLMNPGVAMASHKDDDDRFFPSSGVLIFGKQGAGN

DGVDYSQVLITDEEEIKATNPVATEEYGAVAINNQAANTQAQTGLVHNQG

VIPGMVWQNRDVYLQGPIWAKIPHTDGNFHPSPLMGGFGLKHPPPQILIK

NTPVPADPPLTFNQAKLNSFITQYSTGQVSVEIEWELQKENSKRWNPEIQ

YTSNYYKSTNVDFAVNTEGVYSEPRPIGTRYLTRNL

The VP1 sequence of AAVrh.10 is set out as SEQ ID NO:12 and the locations of the associated variable regions and GBS and GH loop regions are defined in Table 2 below.

MAADGYLPDWLEDNLSEGIREWWDLKPGAPKPKANQQKQDDGRGLVLPGY

KYLGPFNGLDKGEPVNAADAAALEHDKAYDQQLKAGDNPYLRYNHADAEF

QERLQEDTSFGGNLGRAVFQAKKRVLEPLGLVEEGAKTAPGKKRPVEPSP

QRSPDSSTGIGKKGQQPAKKRLNFGQTGDSESVPDPQPIGEPPAGPSGLG

SGTMAAGGGAPMADNNEGADGVGSSSGNWHCDSTWLGDRVITTSTRTWAL

PTYNNHLYKQISNGTSGGSTNDNTYFGYSTPWGYFDFNRFHCHFSPRDWQ

RLINNNWGFRPKRLNFKLFNIQVKEVTQNEGTKTIANNLTSTIQVFTDSE

YQLPYVLGSAHQGCLPPFPADVFMIPQYGYLTLNNGSQAVGRSSFYCLEY

FPSQMLRTGNNFEFSYQFEDVPFHSSYAHSQSLDRLMNPLIDQYLYYLSR

TQSTGGTAGTQQLLFSQAGPNNMSAQAKNWLPGPCYRQQRVSTTLSQNNN

SNFAWTGATKYHLNGRDSLVNPGVAMATHKDDEERFFPSSGVLMFGKQGA

GKDNVDYSSVMLTSEEEIKTTNPVATEQYGVVADNLQQQNAAPIVGAVNS

QGALPGMVWQNRDVYLQGPWAKIPHTDGNFHPSPLMGGFGLKHPPPQILI

KNTPVPADPPTTFSQAKLASFITQYSTGQVSVEIEWELQKENSKRWNPEI

QYTSNYYKSTNVDFAVNTDGTYSEPRPIGTRYLTRNL

The VP1 sequence of AAVanc80 is set out as SEQ ID NO:13 and the locations of the associated variable regions and GBS and GH loop regions are defined in Table 2 below.

MAADGYLPDWLEDNLSEGIREWWDLKPGAPKPKANQQKQDDGRGLVLPGY

KYLGPFNGLDKGEPVNAADAAALEHDKAYDQQLKAGDNPYLRYNHADAEF

QERLQEDTSFGGNLGRAVFQAKKRVLEPLGLVEEGAKTAPGKKRPVEQSP

QEPDSSSGIGKKGQQPARKRLNFGQTGDSESVPDPQPLGEPPAAPSGVGS

NTMAAGGGAPMADNNEGADGVGNASGNWHCDSTWLGDRVITTSTRTWALP

TYNNHLYKQISSQSGGSTNDNTYFGYSTPWGYFDFNRFHCHFSPRDWQRL

INNNWGFRPKKLNFKLFNIQVKEVTTNDGTTTIANNLTSTVQVFTDSEYQ

LPYVLGSAHQGCLPPFPADVFMIPQYGYLTLNNGSQAVGRSSFYCLEYFP

SQMLRTGNNFQFSYTFEDVPFHSSYAHSQSLDRLMNPLIDQYLYYLSRTQ

TTSGTAGNRTLQFSQAGPSSMANQAKNWLPGPCYRQQRVSKTTNQNNNSN

FAWTGATKYHLNGRDSLVNPGPAMATHKDDEDKFFPMSGVLIFGKQGAGN

SNVDLDNVMITNEEEIKTTNPVATEEYGTVATNLQSANTAPATGTVNSQG

ALPGMVWQDRDVYLQGPIWAKIPHTDGHFHPSPLMGGFGLKHPPPQILIK

NTPVPANPPTTFSPAKFASFITQYSTGQVSVEIEWELQKENSKRWNPEIQ

YTSNYNKSTNVDFAVDTNGVYSEPRPIGTRYLTRNL

The VP1 sequence of AAVanc110 is set out as SEQ ID NO:14 and the locations of the associated variable regions and GBS and GH loop regions are defined in Table 2 below.

MAADGYLPDWLEDNLSEGIREWWDLKPGAPKPKANQQKQDDGRGLVLPGY

KYLGPFNGLDKGEPVNAADAAALEHDKAYDQQLKAGDNPYLRYNHADAEF

QERLQEDTSFGGNLGRAVFQAKKRVLEPLGLVEEGAKTAPGKKRPVEQSP

QEPDSSSGIGKTGQQPAKKRLNFGQTGDSESVPDPQPLGEPPAAPSGVGS

NTMASGGGAPMADNNEGADGVGNSSGNWHCDSTWLGDRVITTSTRTWALP

TYNNHLYKQISNGTSGGSTNDNTYFGYSTPWGYFDFNRFHCHFSPRDWQR

LINNNWGFRPKRLNFKLFNIQVKEVTTNEGTKTIANNLTSTVQVFTDSEY

QLPYVLGSAHQGCLPPFPADVFMIPQYGYLTLNNGSQAVGRSSFYCLEYF

PSQMLRTGNNFQFSYTFEDVPFHSSYAHSQSLDRLMNPLIDQYLYYLSRT

QTTGTAGTQTLQFSQAGPSSMANQARNWVPGPCYRQQRVSTTTNQNNNSN

FAWTGATKYHLNGRDSLMNPGVAMASHKDDEDRFFPSSGVLIFGKQGAGN

DNVDYSQVMITNEEEIKTTNPVATEEYGAVATNNQSANTQAQTGLVHNQG

VLPGMVWQNRDVYLQGPIWAKIPHTDGNFHPSPLMGGFGLKHPPPQILIK

NTPVPADPPTTFNQAKLNSFITQYSTGQVSVEIEWELQKENSKRWNPEIQ

YTSNYYKSTNVDFAVNTEGVYSEPRPIGTRYLTRNL

VP1 of Novel Capsid Proteins

Novel AAV VP1 capsid proteins were isolated from tissue from the following mammals: baboon, crab-eating macaque, cynomolgus macaque, marmoset and pig.

The VP1 sequence of a novel AAV capsid isolated from baboon (denoted as Bba.21) is set out as SEQ ID NO:15 (amino acids 1-742) and the locations of the associated variable regions and GBS and GH loop regions are defined in Table 2 below. The VP2 capsid protein spans amino acids 138-742 of SEQ ID NO:15 and the VP3 capsid protein spans amino acids 206-742 of SEQ ID NO:15.

MAADGYLPDWLEDNLSEGIREWWALKPGAPQPKANQQHQDNARGLVLPGY

KYLGPGNGLDKGEPVNEADAAALEHDKAYDQQLKSGDNPYLKYNHADAEF

QQRLATDTSFGGNLGKAVFQAKKRILEPLGLVEEGVKTAPGKKRPLEKTP

NRPTNPDSGKAPAKKKQKDGETADSARRTLDFEDSGAGDGPPEGSSSGEM

SHDAEMRAAPGGNAVEAGQGADGVGNASGDWHCDSTWSEGRVTTTSTRTW

VLPTYNNHLYLRIGTTANSNTYNGFSTPWGYFDFNRFHCHFSPRDWQRLI

NNNWGLRPKSMRVKIFNIQVKEVTTSNGETTVANNLTSTVQIFADSTYEL

PYVMDAGQEGSLPPFPNDVFMVPQYGYCGVVTGENQNQTDRNAFYCLEYF

PSQMLRTGNNFEVSYQFEKVPFHSMYAHSQSLDRMMNPLLDQYLWHPQST

TTGNSLNQGTATTTYGKITTGDFAYYRKNWLPGACIKQQKFSKNASQNYK

IPASGGDALLKYDTHTTSNGRWSNMAPGPPMATAGAGDSDFSNSQLIFAG

PNQSGNTTTSSNNLLFTSEEEIATTNPRDTDMFGQIADNNQNATTAPHIA

NLDAMGIVPGMVWQNRDIYYLGPIWAKVPHTDGHFHPSPLMGGFGLKHPP

PQIFIKNTPVPANPNTTFSAARINSFLTQYSTGQVAVQIDWEIQKEHSKR

WDPEVQFTSNYGTQNSMLWAPDNAGNYHEPRAIGSRFLTHHL

The VP1 sequence of a novel AAV capsid isolated from baboon (denoted as Bba.26) is set out as SEQ ID NO:16 (amino acids 1-739) and the locations of the associated variable regions and GBS and GH loop regions are defined in Table 2 below. The VP2 capsid protein spans amino acids 138-739 of SEQ ID NO:16 and the VP3 capsid protein spans amino acids 206-739 of SEQ ID NO:16.

MAADGYLPDWLEDNLSEGIREWWALKPGAPQPKANQQHQGNSRGLVLPGY

KYLGLFNGLDKGEPVNEADAAALEHDKAYDKQLEQGDDPYLKYNHADAEF

QERLQEDTSFGGNLGRAVFQAKKRILEPLGLVEEAAKTAPGKKRPLEKTP

NQPTDTQAAGQTPAKKRPQGEQSGDSARRQLDFGPQPAAPIGQPPAAPPP

VGSNTMASGGGGPMADDNQGADGVGNASGNWHCDSTWLGDRVITTSTRTW

VLPTYNNHIYKQISSESGATNDNHYFGYSTPWGYFDFNRFHCHFSPRDWQ

RLINNNWGFRPKRLNFKIFNVQVKEVTQIEGGSTIANNLTSTIQVFADSE

YQLPYVLGSAHQGCLPPFPADVFMIPQYGYLTLNNGSQSVGRSSFYCLEY

FPSQMLRTGNNFQFSYTFESVPFHSSYAHSQSLDRIMNPLVDQYLYYLAR

TQTGTGSTTSNTRQLQFYQAGPSNMADQSRNWLPGPMYRQQRVSKTLDQN

SNTNFAWTAASKYNLNGRKSLANPGIAMATHKDDEERFFPQHGVLVFGQT

NATNKTTLDNVLVTSEEEIKATNPVATEEYGTVSSNLQASNTNPTTETVN

NQGILPGMVWQDRDVYLQGPIWAKIPHTDGHFHPSPLMGGFGLKHPPPQI

LIKNTPVPANPPETFTTSKFASYITQYSTGQVSVEIEWELQKENSKRWNP

EIQYTSNYAKSNNVEFSVDAAGVYSEPRPIGTRYLTRNL

The VP1 sequence of a novel AAV capsid isolated from baboon (denoted as Bba.27) is set out as SEQ ID NO:17 (amino acids 1-739) and the locations of the associated variable regions and GBS and GH loop regions are defined in Table 2 below. The VP2 capsid protein spans amino acids 138-739 of SEQ ID NO:17 and the VP3 capsid protein spans amino acids 206-739 of SEQ ID NO:17.

VAADGYLPDWLEDNLSEGIREWWALKPGAPQPKANQQHQDNSRGLVLPGY

KYLGPFNGLDKGEPVNEADAAALEHDKAYDKQLEQGDNPYLKYNHADAEL

QERLQEDTSFGGNLGRAVFQAKKRILEPLGLVEEAAKTAPGKKRPLEKTP

NQPTDTQAAGQTPAKKRPQGEQSGDSARRQLDFDPQPAAPIGQPPAAPPP

VGSNTMASGGGGPMADDNQGADGVGNASGNWHRDSTWLGDRVITTSTRTW

VLPTYNNHIYKQISSESGATNDNHYFGYSTPWGYFDFNRFHCHFSPRDWQ

RLINNNWGFRPKRLNFKIFNIQVKEVTQIEGGSTIANNLTSTIQVFADSE

YQLPYVLGSAHQGCLPPFPADVFMIPQYGYLTLNNGSQSVGRSSFYCLEY

FPSQMLRTGNNFQFSYTFESVPFHSSYAHSQSLDRIMNPLVDQYLYYLAR

TQTGTGSTTSNTRQLQFYQAGPSNMADQSRNWLPGPMYRQQRVSKTLDQN

SNTNFAWTAASKYNLNGRKSLANPGIAMATHKDDEERFFPQHGVLVFGQT

NATNKTTLDNVLITSEEEIKATNPVATEEYGTVSSNLQASNTNPTTETVN

SQGILPGMVWQDRDVYLQGPIWAKIPHTDGHFHPSPLMGGFGLKHPPPQI

LIKNTPVPANPPETFTTSKFASYITQYSTGQVSVEIEWELQKENGKRWNP

EIQYTSNYAKSNNVEFSVDAAGVYSEPRPIGTRYLTRNL

The VP1 sequence of a novel AAV capsid isolated from baboon (denoted as Bba.29) is set out as SEQ ID NO:18 (amino acids 1-739) and the locations of the associated variable regions and GBS and GH loop regions are defined in Table 2 below. The VP2 capsid protein spans amino acids 138-739 of SEQ ID NO:18 and the VP3 capsid protein spans amino acids 206-739 of SEQ ID NO:18.

MAADGYLPDWLEDNLSEGIREWWALKPGAPQPKANQQHQDNSRGLVLPGY
KYLGPFNGLDKGEPVNEADAAALEHDKAYDKQLEQGDNPYLKYNHADAEF
QERLQEDTSFGGNLGRAVFQAKKRILEPLGLVEEAAKTAPGKRRPLEKTP
NQPTDTQAAGQTPAKKRPQGEQSGDSARRQLDFDPQPAAPIGQPPAAPSP
VGSNTMASGGGGPMADDNQGADGVGNASGNWHCDSTWLGDRVITTSTRTW
VLPTYNNHIYKQISSESGATNDNHYFGYSTPWGYFDFNRFHCHFSPRDWQ
RLINNNWGFRPKRLNFKIFNIQVKEVTQIEGGSTIANNLTSTIQVFADSE
YQLPYVLGSAHQGCLPPFPADVFMIPQYGYLTLNNGSQSVGRSSFYCLEY
FPSQMLRTGNNFQFSYTFESVPFHSSYAHSQSLDRIMNPLVDQCLYYLAR
TQTGTGSTTSNTRQLQFYQAGPSNMADQSRNWLPGPMYRQQRVSKTLDQN
SNTNFAWTAASKYNLNGRKSLANPGIAMATHKDDEERFFPQHGVLVFGQT
NATNKTTLDNVLITSEEEIKATNPVATEEYGTVSSNLQASNTNPTTETVN
NQGILPGMVWQDRDVYLQGPIWAKIPHTDGHFHPSPLMGGFGLKHPPPQI
LIKNTPVPANPPETFTTSKFASYITQYSTGQVSVEIEWELQKEDSKRWNP
EIQYTSNYAKSNNVEFSVDAAGVYSEPRPIGTRYLTRNL

The VP1 sequence of a novel AAV capsid isolated from baboon (denoted as Bba.30) is set out as SEQ ID NO:19 (amino acids 1-739) and the locations of the associated variable regions and GBS and GH loop regions are defined in Table 2 below. The VP2 capsid protein spans amino acids 138-739 of SEQ ID NO:19 and the VP3 capsid protein spans amino acids 206-739 of SEQ ID NO:19.

MAADGYLPDWLEDNLSEGIREWWALKPGAPQPKANQQHQDNSRGLVLPGY
KYLGPFNGLDKGEPVNEADAAALEHDKAYDKQLEQGDNPYLKYNHADAEF
QERLQEDTSFGGNLGRAVFQAKKRILEPLGLVEEAAKTAPGKKRPLEKTP
NQPTDTQAAGQTPAKKRPQGGQSGDSARRQLDFDPQPAAPIGQPPAAPSP
VGSNTMASGGGGPMADDNQGADGVGNASGNWHCDSTWLGDRVITTSTRTW
VLPTYNNHIYKQISSESGATNDNHYFGYSTPWGYFDFNRFHCHFSPRDWQ
RLINNNWGFRPKRLNFKIFNIQVKEVTQIEGGSTIANNLTSTIQVFADSE
YLLPYVLGSAHQGCLPPFPADVFMIPQYGYLTLNNGSQSVGRSSFYCLEY
FPSQMLRTGNNFQFSYTFESVPFHSSYAHSQSLDRIMNPLVDQYLYYLAR
TQTGTGSTTSNTRQLQFYQAGPSNMADQSRNWLPGPMYRQQRVSKTLDQN
SNTNFAWTAASKYNLNGRKSLANPGIAMATHKDDEERFFPQHGVLVFGQT
NATNKTTLDNVLITSEEEIKATNPVATEEYGTVSSNLQASNTNPTTETVN
NQGILPGMVWQDRDVYLQGPIWAKIPHTDGHFHPSPLMGGFGLKHPPPQI
LIKNTPVPANPPETFTTSKFASYITQYSTGQVSVEIEWELQKEDSKRWNP
EIQYTSNYAKSNNVEFSVDAAGVYSEPRPIGTRYLTRNL

The VP1 sequence of a novel AAV capsid isolated from baboon (denoted as Bba.31) is set out as SEQ ID NO:20 (amino acids 1-742) and the locations of the associated variable regions and GBS and GH loop regions are defined in Table 2 below. The VP2 capsid protein spans amino acids 138-742 of SEQ ID NO:20 and the VP3 capsid protein spans amino acids 206-742 of SEQ ID NO:20.

MAADGYLPDWLEDNLSEGIREWWALKPGAPQPKANQQHQDNARGLVLPGY
KYLGPGNGLDKGEPVNEADAAALEHDKAYDQQLKSGDNPYLKYNHADAEF
QQRLATDTSFGGNLGKAVFQAKKRILEPLGLVEEGVKTAPGKKHPLEKTP
NRPTNPDSGKAPAKKKQKDGETADSARRTLDFEDSGAGDGPPEGSSSGEM
SHDAEMRAAPGGNAVEAGQGADGVGNASGDWHCGSTWSEGRVTTTSTRTW
VLPTYNNHLYLRIGTTANSNTYNGFSTPWGYFDFNRFHCHFSPRDWQRLI
NNNWGLRPKSMRVKIFNIQVKEVTTSNGETTVANNLTSTVQIFADSTYEL
PYVMDAGQEGSLPPFPNDVFMVPQYGYCGVVTGENQNQTDRNAFYCLECF
PSQMLRTGNNFEISYQFEKVPFHSMYAHSQSLDRMMNPLLDQYLWHLQST
TTGNSLNQGTATTTYGKITTGDFAYYRKNWLPGACIKQQKFSKNASQNYK
IPASGGDALLKYDTHTTLNGRWSNMAPGPPMATAGAGDSDFSNSQLIFAG
PNQSGNTTTSSNNLLFTSEEEIAATNPRDTDMFGQIADNNQNATTAPHIA
NLDAMGIVPGMVWQNRDIYYQGPIWAKVPHTDGHFHPSPLMGGFGLKHPP
PQIFIKNTPVPANPNTTFSAARINSFLTQYSTGQVAVQIDWEIQKEHSKR
WNPEVQFTSNYGTQNSMLWAPDNAGNYHEPRAIGSRFLTHHL

The VP1 sequence of a novel AAV capsid isolated from baboon (denoted as Bba.32) is set out as SEQ ID NO:21 (amino acids 1-742) and the locations of the associated variable regions and GBS and GH loop regions are defined in Table 2 below. The VP2 capsid protein spans amino acids 138-742 of SEQ ID NO:21 and the VP3 capsid protein spans amino acids 206-742 of SEQ ID NO:21.

MAADGYLPDWLEDNLSEGIREWWALKPGAPQPKANQQHQDNARGLVLPGY
KYLGPGNGLDKGEPVNEADAAALEHDKAYDQQLKSGDNPYLKYNHADAEF
QQRLATDTSFGGNLGKAVFQAKKRILEPLGLVEEGVKTAPGKKRPLEKTP
NRPTNPDSGKAPAKKKQKDGETADSARRTLDFEDSGAGDGPPEGSSSGEM
SHDAEMRAAPGGNAVEAGQGADGVGNASGGWHCDSTWSEGRVTTTSTRTW
VLPTYNNHLYLRIGTTANSNTYNGFSTPWGYFDFNRFHCHFSPRDWQRLI
NNNWGLRPKSMRVKIFNIQVKEVTTSNGETTVANNLTSTVQIFADSTYEL
PYVMDAGQEGSLPPFPNDVFMVPQYGYCGVVTGENQNQTDRNAFYCLEYF
PSQMLRTGNNFEISYQFEKVPFHSMYAHSQSLDRMMNPLLDQYLWHLQST
TTGNSLNQGTATTTYGKITTGDFAYYRKNWLPGACIKQQKFSKNASQNYK
IPASGGDALLKYDTHTTLNGRWSSMAPGPPMATAGAGDSDFSNSQLIFAG
PNQSGNTTTSSNNLLFTSEEEIATTNPRDTDMFGQIADNNQNATTAPHIA
NLDAMGIVPGMVWQNRDIYYQGPIWAKVPHTDGHFHPSPLMGGFGLKHPP
PQIFIKNTPVPANPNTTFSAARINSFLTQYSTGQVAVQIDWEIQKEHSKR
WNPEVQFTSNYGTQNSMLWAPGNAGNHHEPRAIGSRFLTHHL

The VP1 sequence of a novel AAV capsid isolated from baboon (denoted as Bba.33) is set out as SEQ ID NO:22 (amino acids 1-742) and the locations of the associated variable regions and GBS and GH loop regions are defined in Table 2 below. The VP2 capsid protein spans amino acids 138-742 of SEQ ID NO:22 and the VP3 capsid protein spans amino acids 206-742 of SEQ ID NO:22.

```
MAADGYLPDWLEDNLSEGIREWWALKPGAPQPKANQQHQDNARGLVLPGY
KYLGPGNGLDKGEPVNEADAAALEHDKAYDQQLKSGDNPYLKYNHADAEF
QQRLATDTSFGGNLGKAVFQAKKRILEPLGLVEEGVKTAPGKKRPLEKTP
NRPTNPDSGRAPAKKKQKDGETADSARRTLDFEDSGAGDGPPEGSSSGEM
SHDAEMRAAPGGNAVEAGQGADGVGNASGDWHCDSTWSEGRVTTTSTRTW
VLPTYNNHLYLRIGTTANSNTYNGFSTPWGYFDFNRFHCHFSPRDWQRLI
NNNWGLRPKSMRVKIFNIQVKEVTTSNGETTVANNLTSTVQIFADSTYEL
PYVMDAGQEGSLPPFPNDVFMVPQYGYCGVVTGENQNQTDRNAFYCLEYF
PSQMLRTGNNFEISYQFEKVPFHSMYAHSQSLDRMMNPLLDQYLWHLQST
TTGNSLNQGTATTTYGKITTGDFAYYRKNWLPGACIKQQKFSKNASQNYK
IPASGGDALLKYDTHTTLNGRWSNMAPGPPMATAGAGDSDFSNSQLIFAG
PNQSGNTTTSSNNLLLTSEEEIATTNPRDTDMFGQIADNNQNATTAPHIA
NLDAMGIVPGMVWQNRDIYYQGPIWAKVPHTDGHFHPSPLMGGFGLKHPP
PQIFIKNTPVPANPNTTFSAARINSFLTQYSTGQVAVQIDWEIQKEHSKR
WNPEVQFTSNYGTQNSMLWAPGNAGNYHEPRAIGSRFLTHHL
```

The VP1 sequence of a novel AAV capsid isolated from baboon (denoted as Bba.34) is set out as SEQ ID NO:23 (amino acids 1-739) and the locations of the associated variable regions and GBS and GH loop regions are defined in Table 2 below. The VP2 capsid protein spans amino acids 138-739 of SEQ ID NO:23 and the VP3 capsid protein spans amino acids 206-739 of SEQ ID NO:23.

```
MAADGYLPDWLEDNLSEGIREWWALKPGAPQPKANQQHQDNSRGLVLPGY
KYLGPFNGLDKGEPVNEADAAALEHDKAYDKQLEQGDNPYLKYNHADAEF
QERLQEDTSFGGILGRAVFQAKKRILEPLGLVEEAAKTAPGKKRPLEKTP
NQPTDTQAAGQTPAKKRPQGEQSGDSARRQLDFDPQPAAPIGQPPAAPSP
VGSNTMASGGGGPMADDNQGADGVGNASGNWHCDSTWLGDRVITTSTRTW
VLPTYNNHIYKQISSESGATNDNHYFGYSTPWGYFDFNRFHCHFSPRDWQ
RLINNNWGFRPKRLNFKIFNIQVKEVTQIEGGSTIANNLTSTIQVFADSE
YQLPYVLGSAHQGCLPPFPADVFMIPQYGYLTLNNGSQSVGRSSFYCLEY
FPSQMLRTGNNFQFSYTFESVPFHSSYAHSQSLDRIMNPLVDQYLYYLAR
TQTGTGSTTSNTRQLQFYQAGPSNMADQSRNWLPGPMYRQQRVSKTLDQN
SNTNFAWTAASKYNLNGRKSLVNPGIAMATHKDDEERFFPQHGVLVFGKT
NATNKTTLENVLVTDEEEVKATNPVATEEYGTVSSNLQSNTTNPTTETVN
NQGILPGMVWQDRDVYLQGPIWAKIPHTDGHFHPSPLMGGFGLKHPPPQI
LIKNTPVPANPPETFTTSKFASYITQYSTGQVSVEIEWELQKENSKRWNP
EIQYTSNYAKSNNVEFSADAAGVYSEPRPIGTRYLTRNL
```

The VP1 sequence of a novel AAV capsid isolated from baboon (denoted as Bba.35) is set out as SEQ ID NO:24 (amino acids 1-739) and the locations of the associated variable regions and GBS and GH loop regions are defined in Table 2 below. The VP2 capsid protein spans amino acids 138-739 of SEQ ID NO:24 and the VP3 capsid protein spans amino acids 206-739 of SEQ ID NO:24.

```
MAADGYLPDWLEDNLSEGIREWWALKPGAPQPKANQQHQDNSRGLVLPGY
KYLGPFNGLDKGEPVNEADAAALEHDKAYDKQLEQGDNPYLKYNHADAEF
QERLQEDTSFGGNLGRAVFQAKKRILEPLGLVEEVAKTAPGKKRPLEKTP
NQPTDTQAAGQTPAKKRPQGEQSGDSARRQLDFDPQPAAPIGQPPAAPSP
VGSNTMASGGGGPMADDNQGADGVGNASGNWHCDSTWLGDRVITTSTRTW
VLPTYNNHIYKQISSESGATNDNHYFGYSTPWGYFDFNRFHCHFSPRDWQ
RLINNNWGFRPKRLNFKIFNIQVKEVTQIEGGSTIANNLTSTIQVFADSE
YQLPYVLGSAHQGCLPPFPADVFMIPQYGYLTLNNGSQSVGRSSFYCLEY
FPSQMLRTGNNFQFSYTFESVPFHSSYAHSQSLDRIMNPLVDQYLYYLAR
TQTGTGSTTSNTRQLQFYQAGPSNMADQSRNWLPGPMYRQQRVSKTLDQN
SNTNFAWTAASKYNLNGRKSLANPGIAMATHKDDEERFFPQHRVLVFGQT
NATNKTTLDNVLITSEEEIKATNPVATEEYGTVSSNLQASNTDPTTETVN
NQGILPGMVWQDRDVYLQGPIWVKIPHTDGHFHPSPLMGGFGLKHPPPQI
LIKNTPVPANPPETFTTSKFASYTTQYSTGQVSVEIEWGLQKENSKRWNP
EIQYTSNYAKSNNVEFSVDAAGVYSEPRPIGTRYLTRNL
```

The VP1 sequence of a novel AAV capsid isolated from baboon (denoted as Bba.36) is set out as SEQ ID NO:25 (amino acids 1-739) and the locations of the associated variable regions and GBS and GH loop regions are defined in Table 2 below. The VP2 capsid protein spans amino acids 138-739 of SEQ ID NO:25 and the VP3 capsid protein spans amino acids 206-739 of SEQ ID NO:25.

```
MAADGYLPDWLEDNLSEGIREWWALKPGAPQPKANQQHQDNSRGLVLPGY
KYLGPFNGLDKGEPVNEAYAAALEHDKAYDKQLEQGDNPYLKYNHADAEF
QERLQEDTSFGGNLGRAVFQAKKRIPEPLGLVEEAAKTAPGKKRPLEKTP
NQPTDTQAAGQTPAKKRPQGEQSGDSARRQLDFDPQPAAPIGQPPAAPSP
VGSNTMASGGGGPMADDNQGADGVGNASGNWHCDSTWLGDRVITTSTRTW
VLPTYNNHIYKQISSESGATNDNHYFGYSTPWGYFDFNRFHCHFSPRDWQ
RLINNNWGFRPKRLNFKIFNIQVKEVTQIEGGSTIANNLTSTIQVFADSE
YQLPYVLGSAHQGCLPPFPADVFMIPQYGYLTLNNGSQSVGRPSFYCLEY
FPSQMLRTGNNFQFSYTFESVPFHSSYAHSQSLDRIMNPLVDQYLYYLAR
TQTGTGSTTSNTRQLQFYQAGPSNMADQSRNWLPGPMYRQQRVSKTLDQN
SNTNFAWTAASKYNLNGRKSLANPGIAMATHKDDEERFFPQHGVLVFGQT
NATNKTTLDNVLITSEEEIKATNPVATEEYGTVSSNLQASNTNPTTETVN
NQGILPGMVWQDRDVYLQGPIWAKIPHTDGHFHPSPLMGGFGLKHPPPQI
LIKNTPVPANPPETFTTSKFASYITQYSTGQVSVEIEWELQKENSKRWNP
EIQYTSNYAKSNNVEFSVDAAGVYSEPRPIGTRYLTRNL
```

The VP1 sequence of a novel AAV capsid isolated from baboon (denoted as Bba.37) is set out as SEQ ID NO:26 (amino acids 1-739) and the locations of the associated variable regions and GBS and GH loop regions are defined in Table 2 below. The VP2 capsid protein spans amino acids 138-739 of SEQ ID NO:26 and the VP3 capsid protein spans amino acids 206-739 of SEQ ID NO:26.

```
MAADGYLPDWLEDNLSEGIREWWALKPGAPQPKANQQHQDNSRGLVLPGY
KYLGPFNGLDKGEPVNEADAAALEHDKAYDKQLEQGDNPYLKYNHADAEF
QERLQEDTSFGGNLGRAVFQAKKRILEPLGLVEEAAETAPGKKRPLEKTP
NQPTDTQAAGQTPAKKRPQGEQSGDSARRQLDFDPQPAAPIGQPPAAPSP
VGSNTMASGGGGPMADDNQGADGVGNASGNWHCDSTWLGDRVITTSTRTW
VLPTYNNHIYKQISSESGATNDNHYFGYSTPWGYFDFNRFHCHFSPRDWQ
RLINNNWGFRPKRLNFKIFNIQVKEVTQTEGGSTIANNLTSTIQVFADSE
YQLPYVLGSAHQGCLPPFPADVFMIPQYGYLTLNNGSQSVGRSSFYCLEY
FPSQMLRTGNNFQFSYTFESVPFHSSYAHSQSLDRIINPLVDQYLYYLAR
TQTGTGSTTSNTRQLQFYQAGPSNMADQSRNWLPGPMYRQQRVSKTLDQN
SNTNFAWTAASKYNLNGRKSLANPGIAMATHKDDEERFFPQHGVLVFGQT
NATNKTTLDNVLITSEEEIKATNPVATEEYGTVSSNLQASNTNPTTETVN
NQGILPGMVWQDRDVYLQGPIWAKIPHTDGHFHPSPLMGGFGLKHPPPQI
LIKNTPVPANPPETFTTSKFASYITQYSTGQVSVEIEWELQKENSKRWNP
EIQYTSNYAKSNNVEFSVDAAGVYSEPRPIGTRYLTRNL
```

The VP1 sequence of a novel AAV capsid isolated from baboon (denoted as Bba.38) is set out as SEQ ID NO:27 (amino acids 1-739) and the locations of the associated variable regions and GBS and GH loop regions are defined in Table 2 below. The VP2 capsid protein spans amino acids 138-739 of SEQ ID NO:27 and the VP3 capsid protein spans amino acids 206-739 of SEQ ID NO:27.

```
MAADGYLPDWLEDNLSEGIRGWWALKPGAPQPKANQQHQDNSRGLVLPGY
KYLGPFNGLDKGEPVNEADAAALEHDKAYDKQLEQGDNPCLKYNHADAEF
QERLQEDTSFGGNLGRAVFQAKKRILEPLGLVEEAAKTAPGKKRPLEKTP
NQPTDTQAAGQTPAKKRPQGEQSGDSARRQLDFDPQPAAPIGQPPAAPSP
VGSNTMASGGGGPMADDNQGADGVGNASGNWHCDSTWLGDRVITTSTRTW
VLPTYNNHIYKQISSESGATNDNHYFGYSTPWGYFDFNRFHCHFSPRDWQ
RLINNNWGFRPKRLNFKIFNIQVKEVTQIEGGSTIANNLTSTIQVFADSE
YQLPYVLGSAHQGCLPPFPADVFMIPQYGYLTLNNGSQSVGRSSFYCLEY
FPSQMLRTGNNFQFSYTFESVPFHSSYAHSQSLDRIMNPLVDQYLYYLAR
TQTGTGSTTSNTRQLQFYQAGPSNMADQSRNWLPGPMYRQQRVSKTLDQN
SNTNFAWTAASKYNLNGRKSLANPGIAMATHKDDEERFFPQHGVLVFGQT
NATNKTTLDNVLITSEEEIKATNPVATEEYGTVSSNLQASNTNPTTETVN
NQGILPGMVWQDRDVYLQGPTWAKIPHTDGHFHPSPLMGGFGLKHPPPQI
LIKNTPVPANPPETFTTSKFASYITQYSTGQVSVEIEWELQKENSKRWNP
EIQYTSNYAKSNNVEFSVDAAGVYSEPRPIGTRYLTRNL
```

The VP1 sequence of a novel AAV capsid isolated from baboon (denoted as Bba.41) is set out as SEQ ID NO:28 (amino acids 1-739) and the locations of the associated variable regions and GBS and GH loop regions are defined in Table 2 below. The VP2 capsid protein spans amino acids 138-739 of SEQ ID NO:28 and the VP3 capsid protein spans amino acids 206-739 of SEQ ID NO:28.

```
MAADGYLPDWLEDNLSEGIREWWALKPGAPQPKANQQHQDNSRGLVLPGY
KYLGPFNGLDKGEPVNEADAAALEHDKAYDKQLEQGDNPYLKYNHADAEF
QERLQEDTSFGGNLGRAVFQAKKRILEPLGLVEEAAKTAPGKKRPLEKTP
NQPTDTQAAGQTPAKKRPQGEQSGDSARRQLDFDPQPAAPIGQPPAAPSP
VGSNTMASGGGGPMADDNQGADGVGNASGNWHCDSTWLGDRVITTSTRTW
VLPTYNNHIYKQISSESGATNDNHYFGYSTPWGYFDFNRFHCHFSPRDWQ
RLINNNWGFRPKRLNFKIFNIQVKEVTQIEGGSTIANNLTSTIQVFADSE
YQLPYVLGSAHQGCLPPFPADVFMIPQYGYLTLNNGSQSVGRSSFYCLEY
FPSQMLRTGNSFQFSYTFESVPFHSSYAHSQSLDRIMNPLVDQYLYYLAR
TQTGTGSTTSNTRQLQFYQAGPSNMADQSRNWLPGPMYRQQRVSKTLDQN
SNTNFAWTAASKYNLNGRKSLANPGIAMATHKDDEERFFPQHGVLVFGQT
NATNKTTLDNVLITSEEEIKATNPVATEEYGTVSSNLQASNTNPTTETVN
NQGILPGMVWQDRDVYLQGPIWAKIPHTDGHFHPSPLMGGFGLKHPPPQI
LIKNTPVPANPPETFTTSKFASYITQYSTGQVSVEIEWELQKENSKRWNP
EIQYTSNYAKSNNVEFSVDAAGVYSEPRPIGTRYLTRNL
```

The VP1 sequence of a novel AAV capsid isolated from baboon (denoted as Bba.42) is set out as SEQ ID NO:29 (amino acids 1-739) and the locations of the associated variable regions and GBS and GH loop regions are defined in Table 2 below. The VP2 capsid protein spans amino acids 138-739 of SEQ ID NO:29 and the VP3 capsid protein spans amino acids 206-739 of SEQ ID NO:29.

```
MAADGYLPDWLEDNLSEGIREWWALKPGAPQPKANQQHQDNSRGLVLPGY
KYLGPFNGLDKGEPVNGADAAALEHDKAYDKQLEQGDNPYLKYNHADAEF
QERLQEDTSFGGNLGRAVFQAKKRILEPLGLVEEAAKTAPGKKRPLEKTP
NQPTDTQAAGQTPAKKRPQGEQSGDSARRQLDFDPQPAAPIGQPPAAPSP
VGSNTMASGGGGPMADDNQGADGVGNASGNWHCDSTWLGDRVITTSTRTW
VLPTYNNHIYKQISSESGATNDNHYFGYSTPWGYFDFNRFHCHFSPRDWQ
RLINNNWGFRPKRLNFKIFNIQVKEVTQIEGGSTIANNLTSTIQVFADSE
YQLPYVLGSAHQGCLPPFPADVFMIPQYGYLTLNNGSQSVGRSSFYCLEY
FPSQMLRTGNNFQFSYTFESVPFHSSYAHSQSLDRIMNPLVDQYLYYLAR
TQTGTGSTTSNTRQLQFYQAGPSNMADQSRNWLPGPMYRQQRVSKTLDQN
SNTNFAWTAASKYNLNGRKSLVNPGIAMATHKDDEERFFPQHGVLVFGKT
NATNKTTLENVLVTDEEEVKATNPVATEEYGTVSSNLQSNTTNPTTETVN
NQGILPGMVWQDRDVYLQGPIWAKIPHTDGHFHPSPLMGGFGLKHPPPQI
LIKNTPVPANPPETFTTSKFASYITQYSTGQVSVEIEWELQKENSKRWNP
EIQYTSNYAKSNNVEFSVDAAGVYSEPRLIGTRYLTRNL
```

The VP1 sequence of a novel AAV capsid isolated from baboon (denoted as Bba.43) is set out as SEQ ID NO:30 (amino acids 1-739) and the locations of the associated variable regions and GBS and GH loop regions are defined in Table 2 below. The VP2 capsid protein spans amino acids 138-739 of SEQ ID NO:30 and the VP3 capsid protein spans amino acids 206-739 of SEQ ID NO:30.

```
MAADGYLPDWLEDNLSEGIREWWALKPGAPQPKANQQHQDNSRGLVLPGY
KYLGPFNGLDKGEPVNEADAAALEHDKAYDKQLEQGDNPYLKYNHADAEF
QERLQEDTSFGGNLGRAVFQAKKRILEPLGLVEEAAKTAPGKKRPLEKTP
NQPTDTQAAGQTPAKKRPQGEQSGDSARRQLDFDPQPAAPIGQPPAAPSP
VGSNTMASGGGGPMADDNQGADGVGNASGNWHCDSTWLGDRVITTSTRTW
VLPTYNNHIYKQISSESGATNDNHYFGYSTPWGYFDFNRFHCHFSPRDWQ
RLINNNWGFRPKRLNFKIFNIQVKEVTQIEGGSTIANNLTSTIQVFADSE
YQLPYVLGSAHQGCLPPFPADVFMIPQYGYLTLNNGSQSVGRSSFYCLEY
FPSQMLRTGNNFQFSYTFESVPFHSSYAHSQSLDRIMNPLVDQYLYYLAR
TQTGTGSTTSNTRQLQFYQAGPSNMADQSRNWLPGPMYRQQRVSKTLDQN
SNTNFAWTAASKYNLNGRKSLVNPGIAMATHKDDEERFFPQHGVLVFGKT
NATNKTTLENVLVTDEEEVKATNPVATEEYGTVSSNLQSNTTNPTTETVN
NQGILPGMVWQDRDVYLQGPIWAKIPHTDGHFHPSPLMGGFGLKHPPPQI
LIKNTPVPANPPETFTTSKFASYITQYSTGQVSVEIEWELQKENSKRWNP
EIQYTSNYAKSNNVEFSVDAAGVYSEPRPIGTRYLTRNL
```

The VP1 sequence of a novel AAV capsid isolated from baboon (denoted as Bba.44) is set out as SEQ ID NO:31 (amino acids 1-739) and the locations of the associated variable regions and GBS and GH loop regions are defined in Table 2 below. The VP2 capsid protein spans amino acids 138-739 of SEQ ID NO:31 and the VP3 capsid protein spans amino acids 206-739 of SEQ ID NO:31.

```
MAADGYLPDWLEDNLSEGIREWWALKPGAPQPKANQQHQDNSRGLVLPGY
KYLGPFNGLDKGEPVNEADAAALEHDKAYDKQLEQGDNPYLKYNHADAEF
QERLQEDTSFGGNLGRAVFQAKKRILEPLGLVEEAAKTAPGKKRPLEKTP
NQPTDTQAAGQTPAKKRPQGEQSGDSARRQLDFDPQPAAPIGQPPAAPSP
VGSNTMASGGGGPMADDNQGADGVGNASGNWHCDSTWLGDRVITTSTRTW
VLPTYNNHIYKQISSESGATNDNHYFGYSTPWGYFDFNRFHCHFSPRDWQ
RLINNNWGFRPKRLNFKIFNIQVKEVTQIEGGSTIANNLTSTIQVFADSE
YQLPYVLGSAHQGCLPPFPADVFMIPQYGYLTLNNGSQSVGRSSFYCLEY
FPSQMLRTGNNFQFSYTFESVPFHSSYAHSQSLDRIMNPLVDQYLYYLAR
TQTGTGSTTSNTRQLQFYQAGPSNMADQSRNWLPGPMYRQQRVSKTLDQD
SNTNFAWTAASKYNLNGRKSLVNPGIAMATHKDDEERFFPQHGVLVFGKT
NATNKTTLENVLVTDEEEVKATNPVATEEYGTVSSNLQSNTTNPTTETVN
NQGILPGMAWQDRDVYLQGPIWAKIPHTDGHFHPSPLMGGFGLKHPPPQI
LIKNTPVPANPPETFTTSKFASYITQYSTGQVSVEIEWELQKENSKRWNP
EIQYTSNYAKSNNVEFSVDAAGVYSEPRPIGTRYLTRNL
```

The VP1 sequence of a novel AAV capsid isolated from crab-eating macaque (denoted as Bce.14) is set out as SEQ ID NO:32 (amino acids 1-736) and the locations of the associated variable regions and GBS and GH loop regions are defined in Table 2 below. The VP2 capsid protein spans amino acids 138-736 of SEQ ID NO:32 and the VP3 capsid protein spans amino acids 203-736 of SEQ ID NO:32.

```
MAADGYLPDWLEDNLSEGIREWWALKPGAPQPKANQQKQDDGRGLVLPGY
KYLGPFNGLDKGEPVNEADAAALEHDKAYDQQLKAGDNPYLRYNHADAEF
QERLQEDTSFGGNLGRAVFQAKKRVLEPLGLVEEAAKTAPGKKRPVEQSP
QEPDSSAGIGKSGAQPAKKRLNFGQTGDTESVPDPQPIGEPPAAPSGVGS
LTMASGGGAPVADNNEGADGVGSSSGNWHCDSQWLGDRVITTSTRTWALP
TYNNHLYKQISNSTSGGSSNDNAYFGYSTPWGYFDFNRFHCHFSPRDWQR
LINNNWGFRPKRLNFKLFNIQVKEVTDNNGVKTIANNLTSTVQVFTDSDY
QLPYVLGSAHEGCLPPFPADVFMIPQYGYLTLNDGSQAVGRSSFYCLEYF
PSQMLRTGNNFTFSYEFENVPFHSSYAHSQSLDRLMNPLIDQYLYYLSKT
INGSGQNQQALKFSVAGPSNMAVQGRNYIPGPSYRQQRVSTTVTQNNNSE
FAWPGASSWALNGRNSLMNPGPAMASHKEGEDRFFPLSGSLIFGKQGTGR
DNVDADKVMITNEEEIKTTNPVATESYGQVATNHQSAQAQAQTGWVQNQG
ILPGMVWQDRDVYLQGPIWAKIPHTDGNFHPSPLVGGFGMKHPPPQILIK
NTPVPADPPTAFNKDKLNSFITQYSTGQVRVEIEWELQKENSKRWNPEIQ
YTSNYYKSNNVEFAVNTEGVYSEPRPIGTRYLTRNL
```

The VP1 sequence of a novel AAV capsid isolated from crab-eating macaque (denoted as Bce.15) is set out as SEQ ID NO:33 (amino acids 1-736) and the locations of the associated variable regions and GBS and GH loop regions are defined in Table 2 below. The VP2 capsid protein spans amino acids 138-736 of SEQ ID NO:33 and the VP3 capsid protein spans amino acids 203-736 of SEQ ID NO:33.

```
MAADGYLPDWLEDNLSEGIREWWALKPGAPQPKANQQKQDDGRGLVLPGY
KYLGPFNGLDKGEPVNEADAAALEHDKAYDQQLKAGDNPYLRYNHADAEF
QERLQEDTSFGGNLGRAVFQAKKRVLEPLGLVEEAAKTAPGKKRPVEQSP
QEPDSSAGIGKSGAQPAKKRLNFGQTGDTESVPDPQPIGEPPAAPSGVGS
LTMASGGGAPVADNNEGADGVGSSSGNWHCDSQWLGDRVITTSTRTWALP
TYNNHLYKQISNSTSGGSSNDNAYFGYSTPWGYFDFNRFHCHFSPRDWQR
LINNNWGFRPKRLNFKLFNIQVKEVTDNNGVKTIANNLTSTVQVFTDSDY
QLPYVLGSAHEGCLPPFPADVFMIPQYGYLTLNDGSQAVGRSSFYCLEYF
PSQMPRTGNNFTFSYEFENVPFHSSYAHSQSLDRLMNPLIDQYLYYLSKT
INGSGQNQQTLKFSVAGPSNMAVQGRNYIPGPSYRQQRVSTTVTQNNNSE
FAWPGASSWALNGRNSLMNPGPAMASHKEGEDRFFPLSGSLIFGKQGTGR
DNVDADKVMITNEEEIKTTNPVATESYGQVATNHQSAQAQAQTGWVQNQG
ILPGMVWQDRDVYLQGPIWAKIPHTDGNFHPSPLMGGFGMKHPPPQILIK
NTPVPADPPTAFNKDKLNSFITQYSTGQVSVAIEWELQKENSKRWNPEIQ
YTSNYYKSNNVEFAVNTEGVYSEPRPIGTRYLTRNL
```

The VP1 sequence of a novel AAV capsid isolated from crab-eating macaque (denoted as Bce.16) is set out as SEQ ID NO:34 (amino acids 1-736) and the locations of the associated variable regions and GBS and GH loop regions are defined in Table 2 below. The VP2 capsid protein spans amino acids 138-736 of SEQ ID NO:34 and the VP3 capsid protein spans amino acids 203-736 of SEQ ID NO:34.

```
MAADGYLPDWLEDNLSEGIREWWALKPGAPQPKANQQKQDDGRGLVLPGY
KYLGPFNGLDKGEPVNEADAAALEHDKAYDQQLKAGDNPYLRYNHADAEF
QERLQEDTSFGGNLGRAVFQAKKRVLEPLGLVEEAAKTAPGKKRPVEQSP
QEPDSSAGIGKSGAQPAKKRLNFGQTGDTESVPDPQPIGEPPAAPSGVGS
LTMASGGGAPVADNNEGADGVGSSSGNWHCDSQWLGDRVITTSTRTWALP
TYNNHLYKQISNSTSGGSSNDNAYFGYSTPWGYFDFNRFHCHFSPRDWQR
LINNNWGFRPKRLNFKLFNIQVKEVTDNNGVKTIANNLTSTVQVFTDSDY
QLPYVLGSAHEGCLPPFPADVFMIPQYGYLTLNDGSQAVGRSSFYCLEYF
PSQMLRTGNNFTFSYEFENVPFHSSYAHSQSLDRPMNPLIDQYLYYLSKT
INGSGQNQQTLKFSVAGPSNMAVQGRNYIPGPSYRQQRVSTTVTQNNNSE
FAWPGASSWALNGRNSLMNPGPAMASHKEGEDRFFPLSGSLIFGKQGTGR
DNVDADKVMITNEEEIKTTNPVATESYGQVATNHQSAQAQAQTGWVQNQG
ILPGMVWQDRDVYLQGPIWAKIPHTDGNFHPSPLMGGFGMKHPPPQILIK
NTPVPADPPTAFNKDKLNSFITQYSTGQVSVEIEWELQKENSKRWNPEIQ
YTSNYYKSNNVEFAVNTEGVYSEPRPIGTRYLTRNL
```

The VP1 sequence of a novel AAV capsid isolated from crab-eating macaque (denoted as Bce.17) is set out as SEQ ID NO:35 (amino acids 1-736) and the locations of the associated variable regions and GBS and GH loop regions are defined in Table 2 below. The VP2 capsid protein spans amino acids 138-736 of SEQ ID NO:35 and the VP3 capsid protein spans amino acids 203-736 of SEQ ID NO:35.

MAADGYLPDWLEDNLSEGIREWWALKPGAPQPKANQQKQDDGRGLVLPGY
KYLGPFNGLDKGEPVNEADAAALEHDKAYDQQLKAGDNPYLRYNHADAEF
QERLQEDTSFGGNLGRAVFQAKKRVLEPLGLVEEAAKTAPGKKRPVEQSP
QEPDSSAGIGKSGAQPAIKRLNFGQTGDTESVPDPQPIGEPPAAPSGVGS
LTMASGGGAPVADNNEGADGVGSSSGNWHCDSQWLGDRVITTSIRTWALP
TYNNHLYKQISNSTSGGSSNDNAYFGYSTPWGYFDFSRFHCHFSPRDWQR
LINNNWGFRPKRLNFKLFNIQVKEVTDNNGVKTIANNLTSTVQVFTDSDY
QLPYVLGSAHEGCLPPFPADVFMIPQYGYLTLNDGSQAVGRSSFYCLEYF
PSQMLRTGNNFTFSYEFENVPFHSSYAHSQSLDRLMNPLIDQYLYYLSKT
INGSGQNQQTLKFSVAGPSNMAVQGRNYIPGPSYRQQRVSTTVTQNNNSE
FAWPGASSWALNGRNSLMNPGPAMASHKEGEDRFFPLSGSLIFGKQGTGR
DNVDADKVMITNEEEIKTTNPVATESYGQVATNHQSAQAQAQTGWVQNQG
ILPGMVWQDRDVYLQGPIWAKIPHTDGNFHPSPLMGGFGMKHPPPQILIK
NTPVPADPPTAFNKDKLNSFITQYSTGQVSVEIEWELQKENSKRWNPEIQ
YTSNYYKSNNVEFAVNTEGVYSEPRPIGTRYLTRNL

The VP1 sequence of a novel AAV capsid isolated from crab-eating macaque (denoted as Bce.18) is set out as SEQ ID NO:36 (amino acids 1-736) and the locations of the associated variable regions and GBS and GH loop regions are defined in Table 2 below. The VP2 capsid protein spans amino acids 138-736 of SEQ ID NO:36 and the VP3 capsid protein spans amino acids 203-736 of SEQ ID NO:36.

MAADGYLPOWLEDNLSEGIREWWALKPGAPQPKANQQKQDDGRGLVLPGY
KYLGPFNGLDKGEPVNEADAAALEHDKAYDQQLKAGDNPYLRYNHADAEF
QERLQEDTSFGGNLGRAVFQAKKRVLEPLGLVEEAAKTAPGKKRPVEQSP
QEPOSSAGIGKSGAQPAKKRLNFGQTGDTESVPDPQPIGEPPAAPSGVGS
LTMASGGGAPVADNNEGADGVGSSSGNWHCDSQWLGDRVITTSTRTWALP
TYNNHLYKQISNSTSGGSSNDNAYFGYSTPWGYFDFNRFHCHFSPRDWQR
LINNNWGFRPKRLNFKLFNIQVKEVTDNNGVKTIANNLTSTVQVFTDSDY
QLPYVLGSAHEGCLPPFPADVFMIPQYGYLTLNDGSQAVGRSSFYCLEYF
PSQMLRTGNNFTFSYEFENVPFHSSYAHSQSLDRLMNPLIDQYLYYLSKT
INGSGQNQQTLKFSVAGPSNMAVQGRNYIPGPSYRQQRVSTTVTQNNNSE
FAWPGASSWALNGRNSLMNPGPAMASHKEGEDRFFPLSGSLIFGKQGTGR
DNVDADKVMITNEEEIKTTNPVATESYGQVATNHQSAQAQAQTGWVQNQG
ILPGMVWQDRDVYLQGPIWAKIPHTDGNFHPSPLMGGFGMKHPPPQILIK
NTPVPADPPTAFNKDKLNSFITQYSTGQVSVEIEWELQKENSKRWNPEIQ
YTSNYYKSNNVEFAVNTEGVYSEPRPIGTRYLTRNL

The VP1 sequence of a novel AAV capsid isolated from crab-eating macaque (denoted as Bce.20) is set out as SEQ ID NO:37 (amino acids 1-733) and the locations of the associated variable regions and GBS and GH loop regions are defined in Table 2 below. The VP2 capsid protein spans amino acids 138-733 of SEQ ID NO:37 and the VP3 capsid protein spans amino acids 203-733 of SEQ ID NO:37.

MAADGYLPDWLEDNLSEGIREWWALKPGAPQPKANQQKQDDGRGLVLPGY
KYLGPFNGLDKGEPVNEADAAALEHDKAYDQQLKAGDNPYLRYNHADAEF
QERLQEDTSFGGNLGRAVFQAKKRVLEPLGLVEEAAKTAPGKKRPVEQSP
QEPDSSAGIGKSGAQPAKKRLNFGQTGDTESVPDPQPIGEPPAAPSGVGS
LTMASGGGAPVADNNEGADGVGSSSGNWHCDSRWLGDRVITTSTRTWALP
TYNNHLYKQISNSTSGGSSNDNAYFGYSTPWGYFDFNRFHCHFSPRDWQR
LINNNWGFRPKRLNFKLFNIQVKEVTDNNGAKTIANNLTSTVQVFTDSDY
QLPYVLGSAHEGCLPPFPADVFMIPQYGYLTLNDGSQAVGRSSFYCLEYF
PSQMLRTGNNFTFSYEFENVPFHSSYAHSQSLDRLMNPLIDQYLYYLSKT
INGSGQNQQTLKFSVAGPSNMAVQGRNYIPGPSYRQQRVSTTVTQNNNSE
FAWPGASSWALNGRNSLMNPGPAMASHKEGEDRFFPLSGSLIFGKQGTGR
DNVDADKVMITNEEEIKTTNPVATESYGQVATNHQSAQAQAQTGWVQNQG
ILPGMVWQDRDVYLQGPIWAKIPHTDGNFHPSPLMGGFGMKHPPPQILIK
NTPVPADPPTAFNKDKLNSFITQYSTGQVSVEIEWELQKENSKRWNPEIQ
YTSNYYKSNNVEFAVNTEGVYSEPRPIGTRYLT

The VP1 sequence of a novel AAV capsid isolated from crab-eating macaque (denoted as Bce.35) is set out as SEQ ID NO:38 (amino acids 1-730) and the locations of the associated variable regions and GBS and GH loop regions are defined in Table 2 below. The VP2 capsid protein spans amino acids 138-730 of SEQ ID NO:38 and the VP3 capsid protein spans amino acids 199-730 of SEQ ID NO:38.

```
MAADGYLPDWLEDNLSEGIREWWALKPGAPQPKANQQKQDDGRGLVLPGYK
YLGPFNGLDKGEPVNEADAAALEHDKAYDQQLKAGDNPYLRYNHADAEFQE
RLQEDTSFGGNLGRAVLQAKKRVLEPLGLVEEAAKTAPGKKRPVDSPDSTS
GIGKKGQQPARKRLNFGQTGDAESVPDPQPIGEPPAAPSGLGSGTMAAGGG
APMADNNEGADGVGNASGNWHCDSTWLGNRVITTSTRTWALPTYNNHLYKQ
ISSSSSGATNDNHYFGYSTPWGYFDFNRFHCHFSPRDWQRLINNNWGFRPK
RLRFKLFNIQVKEVTTNDGVTTIANNLTSTVQVFSDSEYQLPYVLGSAHQG
CLPPFPADVFMIPQYGYLTLNNGSQSVGRSSFYCLEYFPSQMLRTGNNFEF
SYEFEDVPFHSSYAHSQSLDRLMNPLIDQYLYYLARTQSSTGTSTRELQFH
QAGPATMAEQSKNWLPGPCFRQQRISKTTDNNNNSNFAWTGATKYHLNGRS
SLTNPGVPMATHKDDESVFFPINGVLVFGKTGASNKTTLENVLMTDEEEIK
ATNPVATEEYGVVSSNIQSQNSNPTTQTVNNQGALPGMVWQNRDVYLQGPI
WAKIPHTDGNFHPSPLMGGFGLKHPPPQILIKNTPVPANPPETFTPAKFAS
FITQYSTGQVSVEIEWELQKENSKRWNPEIQYTSNYDKQTGVGFAVDTQGV
YSEPRPIGTRYLTRNL
```

The VP1 sequence of a novel AAV capsid isolated from crab-eating macaque (denoted as Bce.36) is set out as SEQ ID NO:39 (amino acids 1-730) and the locations of the associated variable regions and GBS and GH loop regions are defined in Table 2 below. The VP2 capsid protein spans amino acids 138-730 of SEQ ID NO:39 and the VP3 capsid protein spans amino acids 199-730 of SEQ ID NO:39.

```
MAADGYLPDWLEDNLSEGIREWWALKPGAPQPKANQQKQDDGRGLVLPGYK
YLGPFNGLDKGEPVNEADAAALEHDKAYDQQLKAGDNPYLRYNHADAEFQE
RLQEDTSFGGNLGRAVFQAKKRVLEPLGLVEEAAKTAPGKKRPVDSPDSTS
GIGKKGQQPARKRLNFGQTGDAESVPDPQPIGEPPAAPSGLGSGTMAAGGG
APMADNNEGADGVGNASGNWHCDSTWLGNRVITTSTRTWALPTYNNHLYKQ
ISSSSSGATNDNHYFGYSTPWGYFDFNRFHCHFSPRDWQRLINNNWGFRPK
RLRFKLFNIQVKEVTTNDGVTTIANNLTSTVQVFSDSEYQLPYVLGSAHQG
CLPPFPADVFMIPQYGYLTLNNGSQSVGRSSFYCLEYFPSQMLRTGNNFEF
SYEFEDVPFHSSYAHSQSLDRLMNPLIDQYLYYLARTQSSTGTSTRELQFH
QAGPATMAEQSKNWLPGPCFRQQRISKTTDNNNNSNFAWTGATKYHLNGRN
SLTNPGVPMATHKDDESVFFPINGVLVFGKTGASNKTTLENVLMTDEEEIK
ATNPVATEEYGVVSSNIQSQNSNPTTQTVNNQGALPGMVWQNRDVYLQGPI
WAKIPHTDGNFHPSPLMGGFGLKHPPPQILIKNTPVPANPPETFTPAKFAS
FITQYSTGQVSVEIEWELQKENSKRWNPEIQYTSNYDKQTGVDFAVDTQGV
YSEPRPIGTRYLTRNL
```

The VP1 sequence of a novel AAV capsid isolated from crab-eating macaque (denoted as Bce.39) is set out as SEQ ID NO:40 (amino acids 1-736) and the locations of the associated variable regions and GBS and GH loop regions are defined in Table 2 below. The VP2 capsid protein spans amino acids 138-736 of SEQ ID NO:40 and the VP3 capsid protein spans amino acids 203-736 of SEQ ID NO:40.

```
MAADGYLPDWLEDNLSEGIREWWDLKPGAPKPKANQQKQDDGRGLVLPGYK
YPGPFNGLDKGEPVNAADAAALEHDKAYDQQLKAGNPYLRYNHADAEFQER
LQEDDTSFGGNLGRAVFQAKKRVFEPLGLVEEGAKTAPGKKRPVEQSPQEP
DSSSGIGKTGQQPAKKRLNFGQTGDSESVPDPQPLGEPPAAPSGLGPNTMA
SGGGAPMADNNEGADGVGNSSGNWHCDSTWLGDRVITTSTRTWALPTYNNH
LYKQISNSTSGGSTNDNTYFGYSTPWGYFDFNRFHCHFSPRDWQRLINNNW
GFRPKRLNFKLFNIQVKEVTTNEGTKTIANNLTSTVQVFTDSEYQLPYVLG
SAHQGCLPPFPADVFMVPQYGYLTLNNGSQALGRSSFYCLEYFPSQMLRTG
NNFQFSYTFEDVPFHSSYAHSQSLDRLMNPLIDQYLYYLVRTQTTGTGGTQ
TLAFSQAGPSSMANQARNWVPGPSYRQQRVSTTKNQNNNSNFAWTGAAKFK
LNGRNSLMNPGVAMASHKDDEDRFFPSSGVLIFGKQGAGNDGVDYSQVLIT
DEEEIKATNPVATEEYGEVAINDQAANTQAQTGLVHNQGVIPGMVWQNRDV
YLQGPIWAKIPHTDGNFHPSPLMGGFGLMHPPPQILIKNTPVPADPPLTFN
QAKLNSFITQYSTGQVSVEIEWELQKENSKRWNPEIQYTSNYYKSTNVDFA
VNSDGVYSEPRPIGTRYLTRNL
```

The VP1 sequence of a novel AAV capsid isolated from crab-eating macaque (denoted as Bce.40) is set out as SEQ ID NO:41 (amino acids 1-736) and the locations of the associated variable regions and GBS and GH loop regions are defined in Table 2 below. The VP2 capsid protein spans amino acids 138-736 of SEQ ID NO:41 and the VP3 capsid protein spans amino acids 203-736 of SEQ ID NO:41.

```
MAADGYLPDWLEDNLSEGIREWWDLKPGAPKPKANQQKQDDGRGLVLPGYK
YLGPFNGLDKGEPVNAADAAALEHDKAYDQQLKAGDNPYLRYNHADAEFQG
RLQEDTSFGGNLGRAVFQAKKRVLEPLGLVEEGAKTAPGKKRPVEQSPQEP
DSSSGIGKTGQQPAKKRLNFGQTGDSESVPDPQPLGEPPAAPSGLGPNTMA
SGGGAPMADNNEGADGVGNSSGNWHCDSTWLGDRVITTSTRTWALPTYNNH
LYKQISNSTSGGSTNDNTYFGYSTPWGYFDFNRFHCHFSPRDWQRLINNNW
GFRPKRPNFKLFNIQVKEVTTNEGTKTIANNLTSTVQAFTDSEYQLPYVLG
SAHQGCLPPFPADVFMVPQYGYLTLNNGSQALGRSSFYCLEYFPSQMLRTG
NNFQFSYTFEDVPFHSSYAHSQSLDRLMNPLIDQYLYYLVRTQTTGTGGTQ
TLAFSQAGPSSMANQARNWVPGPSYRQQRVSTTKNQNNNSNFAWTGAAKFK
LNGRNSLMNPGVAMASHKDDEDRFSPSSGVLIFGKQGAGNDGVDYSQVLIT
DEEEIKATNPVATEEYGEVAINDQAANTQAQTGLVHNQGVIPGMVWQNRDV
YLQGPIWAKIPHTDGNFHPSPLMGGFGLKHPPPQILIKNTPVPADPPLTFN
QAKLNSFITQYSTGQVSVEIEWELQKENSKRWNPEIQYTSNYYKSTNVDFA
VNSDGVYSEPRPIGTRYLTRNL
```

The VP1 sequence of a novel AAV capsid isolated from crab-eating macaque (denoted as Bce.41) is set out as SEQ ID NO:42 (amino acids 1-736) and the locations of the associated variable regions and GBS and GH loop regions are defined in Table 2 below. The VP2 capsid protein spans amino acids 138-736 of SEQ ID NO:42 and the VP3 capsid protein spans amino acids 203-736 of SEQ ID NO:42.

```
MAADGYLPDWLEDNLSEGIREWWDLKPGAPKPKANQQKQDDGRGLVLPGYK
YLGPFNGLDKGEPVNAADAAALEHDKAYDQQLKAGDNPYLRYNHADAEFQG
RLQEDTSFGGNLGRAVFQAKKRVLEPLGLVEEGAKTAPGKKRPVEQSPQEP
DSSSGIGKTGQQPAKKRLNFGQTGDSESVPDPQPLGEPPAAPSGLGPNTMA
SGGGAPMADNNEGADGVGNSSGNWHCDSTWLGDRVITTSTRTWALPTYNNH
LYKQISNSTSGGSTNDNTYFGYSTPWGYFDFNRFHCHFSPRDWQRLINNNW
GFRPKRLNFKLFNIQVKEVTTNEGTKTIANNLTSTVQVFTDSEYQLPYVLG
SAHQGCLPPFPADVFMVPQYGYLTLNNGSQALGRSSFYCLEYFPSQMLRTG
NNFQFSYTFEDVPFHSSYAHSQSLDRLMNPLIDQYLYYLVRTQTTGTGGTQ
ILAFSQAGPSSMANQARNWVPGPSYRQQRVSTTKNQNNNSNFAWTGAAKFK
LNGRNSLMNPGVAMASHKDDEDRFFPSSGVLIFGKQGAGNDGMDYSQVLIT
DEEEIKATNPVATEEYGEVAINDQAANTQAQTGLVHNQGVIPGMVWQNRDV
YLQGPIWAKIPHTDGNFHPSPLMGGFGLKHPPPQILIKNTPVPADPPLTFN
QAKLNSFITQYSTGQVSVEIEWELQKENSKRWNPEIQYTSNYYKSTNVDFA
VNSDGVYSEPRPIGTRYLTRNL
```

The VP1 sequence of a novel AAV capsid isolated from crab-eating macaque (denoted as Bce.42) is set out as SEQ ID NO:43 (amino acids 1-736) and the locations of the associated variable regions and GBS and GH loop regions are defined in Table 2 below. The VP2 capsid protein spans amino acids 138-736 of SEQ ID NO:43 and the VP3 capsid protein spans amino acids 203-736 of SEQ ID NO:43.

MAADGYLPDWLEDNLSEGIREWWDLKPGAPKPKANQQKQDDGRGLVLPGYK

YLGPFNGLDKGEPVNAADAAALEHDKAYDQQLKAGDNPYLRYNHADAEFQE

RLQEDTSFGGNLGRAVFQAKKRVLEPLGLVEEGAKTAPGKKRPVEQSPQEP

DSSSGIGKTGQQPAKKRLNFGQTGDSESVPDPQPLGEPPAAPSGLGPNTMA

SGGGAPMADNNEGADGVGNSSGNWHCDSTWLGDRVITTSTRTWALPTYNNH

LYKQISNSTSGGGTNDNTYFGYSTPWGYFDFNRFHCHFSPRDWQRLINNNW

GFRPKRLNFKLFNIQVKEVTTNEGTKTIANNLTSTVQVFTDSEYQLPYVLG

SAHQGCLPPFPADVFMVPQYGHLTLNNGSQALGRSSFYCLEYFPSQMLRTG

NNFQFSYTFEDVPFHSSYAHSQSLDRLMNPLIDQYLYYLVRTQTTGTGGTQ

TLAFSQAGPSSMANQARNWVPGPSYRQQRVSTTKDQNNNSNFAWTGAAKFK

LNGRNSLMNPGVAMASHKDDEDRFFPSSGVLIFGKQGAGNDGVDYSQVLIT

DEEEIKATNPVATEEYGEVAVNDQAANTQAQTGLVHNQGVIPGMVWQNRDV

YLQGPIWAKIPHTDGNFHPSPLMGGFGLKHPPPQILIKNTPVPADPPLTLN

QAKLNSFITQYSTGQVSVEIEWELQKENSKRWNPEIQYTSNYYKSTNVDFA

VNSDGVYSEPRPIGTRYLTRNL

The VP1 sequence of a novel AAV capsid isolated from crab-eating macaque (denoted as Bce.43) is set out as SEQ ID NO:44 (amino acids 1-730) and the locations of the associated variable regions and GBS and GH loop regions are defined in Table 2 below. The VP2 capsid protein spans amino acids 138-730 of SEQ ID NO:44 and the VP3 capsid protein spans amino acids 199-730 of SEQ ID NO:44.

MAADGYLPDWLEDNLSEGIREWWALKPGAPQPKANQQKQDDGRGLVLPGYK

YLGPFNGLDKGEPVNEADAAALEHDKAYDQQLKAGDNPYLRYNHADAEFQE

RLQEDTSFGGNLGRAVFQAKKRVLEPLGLVEEAAKTAPGKKRPVDSPDSTS

GIGKKGQQPARKRLNFGQTGDAESVPDPQPIGEPPAAPSGLGSGTMAAGGG

APMADNNEGADGVGNAPGNWHCDSTWLGNRVITTSTRTWALPTYNNHLYKQ

ISSSSSGATNDNHYFGYSTPWGYFDFNRFHCHFSPRDWPRLINNNWGFRPK

RLRFKLFNIQVKEVTTNDGVTTIANNLTSTVQVFSDSEYQLPYVLGSAHQG

CLPPFPADVFMIPQYGYLTLNNGSQSVGRSSFYCLEYFPSQMLRTGNNFEF

SYEFEDVPFHSSYAHSQSLDRLMNPLIDQYPYYLARTQSSTGTSTRELQFH

QAGPATMAEQSKNWLPGPCFRQQRISKTTDNNNNSNFAWTGATKYHLNGRN

SLTNPGVPMATHKDDESVFFPINGVLVFGKTGASNKTTLENVLMTDEEEIK

ATNPVATEEYGVVSSNIQSQNSNPATQTVNNQGALPGMVWQNRDVYLQGPI

WAKIPHTDGNFHPSPLMGGFGLKHPPPQILIKNTPVPANPPETFTPAKFAS

FITQYSTGQVSVEIEWELQKENSKRWNPEIQYTSNYDKQTGVDFAVDTQGV

YSEPRPIGTRYLTRNL

The VP1 sequence of a novel AAV capsid isolated from crab-eating macaque (denoted as Bce.44) is set out as SEQ ID NO:45 (amino acids 1-730) and the locations of the associated variable regions and GBS and GH loop regions are defined in Table 2 below. The VP2 capsid protein spans amino acids 138-730 of SEQ ID NO:45 and the VP3 capsid protein spans amino acids 199-730 of SEQ ID NO:45.

MAADGYLPDWLEDNLSEGIREWWALKPGAPQPKANQQKQDDGRGLMLPGYK

YLGPFNGLDKGEPVNEADAAALEHDKAYDQQLKAGDNPYLRYNHADAEFQE

RLQEDTSFGGNLGRAVFQAKKRVLEPLGLVEEAAKTAPGKKRPVDSPDSTS

GIGKKGQQPARKRLNFGQTGDAESVPDPQPIGEPPAAPSGLGSGTMAAGGG

APMADNNEGADGVGNASGSWHCDSTWLGNRVITTSTRTWALPTYNNHLYKQ

ISSSSSGATNDNHYFGYSTPWGYFDFNRFHCHFSPRDWQRLINNNWGFRPK

RLRFKLFNIQVKEVTTNDGVTTIANNLTSTVQVFSDSEYQLPYVLGSAHQG

CLPPFPADVFMIPQYGYLTLNNGRQSVGRSSFYCLEYFPSQMLRTGNNFEF

SYEFEDVPFHSSYAHSQSLDRLMNPLIDQYPYYLARTQSSTGTSTRELQFH

QAGPATMAEQSKNWLPGPCFRQQRISKTTDNNNNSNFAWTGATKYHLNGRN

SLTNPGVPMATHKDDESVFFPINGVLVFGKTGASNKTTLENVPMTDEEEIK

ATNPVATEEYGVVSSNIQSQNSNPTTQTVNNQGALPGMVWQNRDVYLQGPI

WAKIPHTDGNFHPSPLMGGFGLKHPPPQILIKNTPVPANPPETFTPAKFAS

FITQYSTGQVSVEIEWELQKENNKRWNPEIQYTSNYDKQTGVDFAVDTQGV

YSEPRPIGTRYLTRNL

The VP1 sequence of a novel AAV capsid isolated from crab-eating macaque (denoted as Bce.45) is set out as SEQ ID NO:46 (amino acids 1-730) and the locations of the associated variable regions and GBS and GH loop regions are defined in Table 2 below. The VP2 capsid protein spans amino acids 138-730 of SEQ ID NO:46 and the VP3 capsid protein spans amino acids 199-730 of SEQ ID NO:46.

```
MAADGYLPDWLEDNLSEGIREWWALKPGAPQPKANQQKQDDGRGLVLPGYK
YLGPFSGLDKGEPVNEADAAALEHDKAYDQQLKAGDNPYLRYNHADAEFQE
RLQEDTSFGGNLGRAVFQAKKRVLEPLGLVEEAAKTAPGKKRPVDSPDSTS
GIGKKGQQPARKRLNFGQTGDAESVPDPQPIGEPPAAPSGLGSGTMAAGGG
APMADNNEGADGVGNASGNWHCDSTWLGNRVITTSTRTWALPTYNDHLYKQ
ISSSSSGATNDNHYFGYSTPWGYFDFNRFHCHFSPRDWQRLINNNWGFRPK
RLRFKLFNIQVKEVTTNDGVTTIANNLTSTVQVFSDSEYQLPYVLGSAHQG
CLPPFPADVFMIPQYGYLTLNNGSQSVGRSSFYCLEYFPSQMLRTGNNFEF
SYEFEDVPFHSSYAHSQSLDRLMNPLIDQYLYYLARTQSSTGTSTRELQFH
QAGPATMAEQSKNWLPGPCFRQQRISKTTDNNNNSNFAWTGATKYHLNGRN
SLTNPGVPMATHKDDESVFFPINGVLVFGKTGASNKTTLENVLMTDEEEIK
ATNPVATEEYGVVSSNIQSQNSNPTTQTVNNQGALPGMVWRNRDVYLQGPI
WAKIPHTDGNFHPSPLMGGFGLKHPPPQILIKNTPVPANPPETFTPAKFAS
FITQYSTGQVSVEIEWELQKENSKRWNPEIQYTSNYDKQTGVDFAVDTQGV
YSEPRPIGTRYLTRNL
```

The VP1 sequence of a novel AAV capsid isolated from crab-eating macaque (denoted as Bce.46) is set out as SEQ ID NO:47 (amino acids 1-730) and the locations of the associated variable regions and GBS and GH loop regions are defined in Table 2 below. The VP2 capsid protein spans amino acids 138-730 of SEQ ID NO:47 and the VP3 capsid protein spans amino acids 199-730 of SEQ ID NO:47.

```
MAADGYLPDWLEDNLSEGIREWWALKPGAPQPKANQQKQDDGRGLVLPGYK
YLGPFNGLDKGEPVNEADAAALEHDKAYDQQLKAGDNPYLRYNHADAEFQE
RLQEDTSFGGNLGRAVFQAKKRVLEPLGLVEEAAKTAPGKKRPVDSPDSTS
GIGKKGQQPARKRLNFGQTGDAESVPDPQPIGEPPAAPSGLGSGTMAAGGG
APMADNNEGADGVGNASGNWHCDSTWLGNRVITTSTRTWALPTYNNHLYKQ
ISSSSSGATNDNHYFGYSTPWGYFDFNRFHCHFSPRDWQRLINNNWGFRPK
RLRFKLFNIQVKEVTTNDGVTTIANNLTSTVQVFSDSEYQLPYVLGSAHQG
CLPPFPADVFMIPQYGYLTLNNGSQSVGRSSFYCLEYFPSQMLRTGNNFEF
SYEFEDVPFHSSYAHSQSLDRLMNPLIDQYLYYMARTQSSTGTSTREPQFH
QAGPATMAEQSKNWLPGPCFRQQRISKTTDNNNNSNFAWTGATKYHLNGRN
SLTNPGVPMATHKDDESVFFPINGVLVFGKTGASNKTTLENVLMTDEEEIK
ATNPVATEEYGVVSSNIQSQNSNPTTQTVNNQGALPGMVWQNRDVYLQGPI
WAKIPHTDGDFHPSPLMGGFGLKHPPPQILIKNTPVPANPPETFTPAKFAS
FITQYSTGQVSVEIEWELQKENSKRWNPEIQYTSNYDKQTGVDFAVDTQGV
YSEPRPIGTRYLTRNL
```

The VP1 sequence of a novel AAV capsid isolated from cynomolgus macaque (denoted as Bcy.20) is set out as SEQ ID NO:48 (amino acids 1-730) and the locations of the associated variable regions and GBS and GH loop regions are defined in Table 2 below. The VP2 capsid protein spans amino acids 138-730 of SEQ ID NO:48 and the VP3 capsid protein spans amino acids 199-730 of SEQ ID NO:48.

```
MAADGYLPDWLEDNLSEGIREWWALKPGAPQPKANQQKQDDGRGLVLPGYK
YLGPFNGLDKGEPVNEADAAALEHDKAYDQQLKAGDNPYLRYNHADAEFQE
RLQEDTSFGGNLGRAVFQAKKRVLEPLGLVEEAAKTAPGKKRPVDSPDSTS
GIGKKGQQPARKRLNFGQTGDAESVPDPQPIGEPPAAPSGLGSGTMAAGGG
APMADNNEGADGVGNASGNWHCDSTWLGNRVITTSTRTWALPTYNNHLYKQ
ISSGSSGATNDNHYFGYSTPWGYFDFNRFHCHFSPRDWQRLINNNWGFRPK
RLRFKLFNIQVKEVTTNDGVTTIANNLTSTVQVFSDSEYQLPYVLGSAHQG
CLPPFPADVFMIPQYGYLTLNNGSQSVGRSSFYCLEYFPSQVLRTGNNFEF
SYEFEDVPFHSSYAHSQSLDRLMNPLIDQYLYYLARTQSSTGTSTRELQFH
QAGPATMAEQSKNWLPGPCFRQQRISKTSDNNNNSNFAWTGATKYHLNGRN
SLTNPGVPMATHKDDESVFFPINGVLVFGKTGASNKTTLENVLMTDEEEIK
ATNPVATEEYGVVSSNIQSQNSNPTTQTVNNQGALPGMVWQNRDVYLQGPI
WAKIPHTDGNFHPSPLMGGFGLKHPPPQILIKNTPVPANPPETFTPAKFAS
FITQYSTGQVSVEIEWELQKENSKRWNPEIQYTSNYDKQTGVDFAVDTQGV
YSEPRPIGTRYLTRNL
```

The VP1 sequence of a novel AAV capsid isolated from cynomolgus macaque (denoted as Bcy.22) is set out as SEQ ID NO:49 (amino acids 1-730) and the locations of the associated variable regions and GBS and GH loop regions are defined in Table 2 below. The VP2 capsid protein spans amino acids 138-730 of SEQ ID NO:49 and the VP3 capsid protein spans amino acids 199-730 of SEQ ID NO:49.

```
MAADGYLPDWLEDNLSEGIREWWALKPGAPQPKANQQKQDDGRGLVLPGYR
YLGPFNGLDKGEPVNEADAAALEHDKAYDQQLKAGDNPYLRYNHADAEFQE
RLQEDTSFGGNLGRAVFQAKKRILEPLGLVEEAAKTAPGKERPVDSPDSTS
GIGKKGQQPARKRLNFGQTGDAESVPDPQPIGEPPAAPSGLGSGTMAAGGG
APMADNNEGADGVGNASGNWHCDSTWLGNRVITTSTRTWALPTYDNHLYKQ
ISSSSSGATNDNHYFGYSTPWGYFDFNRFHCHFSPRDWQRLINNNWGFRPK
RLRFKLFNIQVKEVTTNDGVTTIANNLTSTVQVFSDSEYQLPYVLGSAHQG
CLPPFPADVFMIPQYGYLTLNNGSQSVGRSSFYCLEYFPSQMLRTGNNFEF
SYEFEDVPFHSSYAHSQSLDRLMNPLIDQYLYYLARTQSSTGTSTRELQFH
QAGPATMAEQSKNWLPGPCFRQQRISKTTDNNNNSNFAWTGATKYHLNGRN
SLTNPGVPMATHKDDESVFFPINGVLVLGKTGASNKTTLENVLMTDEEEIK
ATNPVATEEYGVVSSNIQSQNSNPTTQTVNNQGALPGMVWQNRDVYLQGPI
WAKIPHTDGNFHPSPLMGGFGLKHPPPQILIKNTPVPANPPETFTPAKFAS
FITQYSTGQVSVEIEWELQKENSKRWNPEIQYTSNYDKQTGVDFAVDTQGV
YSEPRPIGTRYLTRNL
```

The VP1 sequence of a novel AAV capsid isolated from cynomolgus macaque (denoted as Bcy.23) is set out as SEQ ID NO:50 (amino acids 1-730) and the locations of the associated variable regions and GBS and GH loop regions are defined in Table 2 below. The VP2 capsid protein spans amino acids 138-730 of SEQ ID NO:50 and the VP3 capsid protein spans amino acids 199-730 of SEQ ID NO:50.

MAADGYLPDWLEDNLSEGIREWWALKPGAPRPKANQQKQDDGRGLVLPGYK
YLGPFNGLDKGEPVNEADAAALEHDKAYDQQLKAGDNPYLRYNHADAEFQE
RLQEDTSFGGNLGRAVFQAKKRVLEPLGLVEEAAKTAPGKKRPVDSPDSTS
GIGKKGQQPARKRLNFGQTGDAESVPDPQPIGEPPAAPSGLGSGTMAAGGG
APMADNNEGADGVGNASGNWHCDSTWLGNRVITTSTRTWALPTYNNHLYKQ
ISSSSSGATNDNHYFGYSTPWGYFDFNRFHCHFSPRDWQRLINNNWGFRPK
RLRFKLFNIQVKEVTTNDGVTTIANNLTSTVQVFSDSEYQLPYVLGSAHQG
CLPPFPADVFMIPQYGYLTLNNGSQSVGRSSFYRLEYFPSQMLRTGNNFEF
SYEFEDVPFHSSYAHSQSLDRLMNPLIDQYLYYLARTQSSTGTSTRELQFH
QAGPATMAEQSKNWLPGPCFRQQRISKTTDNNNNSNFAWTGATKYHLNGRN
SLTNPGVPMATHRDDESVFFPINGVLVFGKTGASNKTTLENVLMTDEEEIK
ATNPVATEEYGVVSSNIQSQNSNPTTQTVNNQGALPGMVWQNRDVYLQGPI
WAKIPHTDGNFHPSPLMGGFGLKHPPPQILIKNTPVPANPPETFTPAKFAS
FITQYSTGQVSVEIEWELQKENSKRWNPEIQYTSNYDKQTGVDFAVDTQGV
YSEPRPIGTRYLTRNL

The VP1 sequence of a novel AAV capsid isolated from marmoset (denoted as Bma.42) is set out as SEQ ID NO:51 (amino acids 1-736) and the locations of the associated variable regions and GBS and GH loop regions are defined in Table 2 below. The VP2 capsid protein spans amino acids 138-736 of SEQ ID NO:51 and the VP3 capsid protein spans amino acids 203-736 of SEQ ID NO:51.

MAADGYLPDWLEDNLSEGIREWWDLKPGAPKPKANQQKQDDGRGLVLPGYK
YLGPFNGLDKGEPVNAADAAALEHDKAYDQQLKAGDNPYLRYNHADAEFQE
RLQEDTSFGGNLGRAVFQAKKRVLEPLGLVEEGAKTAPGKKRPVEQSPQEP
DSSSGIGKTGQQPAKKRLNFGQTGDTESVPDPQPLREPPAAPSGLGPNTMA
SGGGAPMADNNEGADGVGNSSGNWHCDSTWLGDRVITTSTRTWALPTYNNH
LYKQISNGTSGGSTNDNTYFGYSTPWGYFDFNRFHCHFSPRDWQRLINNNW
GFRPKRLNFKPFNIQVKEVTTNEGTKTIANNPTSTVQVFTDSEYQLPYVLG
SARQGCLPPFPADVFMVPQYGYLTLNNGSQALGRSSFYCLEYFPSQMLRTG
DNFQFSYTFEDVPFHSSYAHSQSLDRLMNPLIDQYLYYLVRTQTTGTGGTQ
TLAFSQAGPSSMANQARNWVPGPCYRQQRVSTTTNQNNNSNFAWTGAAKFK
LNGRDSLMNPGVAMASHKDDEDRFFPSSGVLIFGKQGAGNDGVDYSQVLIT
DEEEIKATNPVATEEYGAVAINNQAANTLAQTGLVHNQGVIPGMVWQNRDV
YLQGPIWAKIPHTDGNFHPSPLMGGFGLKHPPPQILIKNTPVPADPPLTFN
QAKLNSFITQYSTGQVSVEIEWELQKENSKRWNPEIQYTSNYYKSTNVDFA
VNTEGVYSEPRPIGTRYLTRNL

The VP1 sequence of a novel AAV capsid isolated from marmoset (denoted as Bma.43) is set out as SEQ ID NO:52 (amino acids 1-736) and the locations of the associated variable regions and GBS and GH loop regions are defined in Table 2 below. The VP2 capsid protein spans amino acids 138-736 of SEQ ID NO:52 and the VP3 capsid protein spans amino acids 203-736 of SEQ ID NO:52.

MAADGYLPDWLEDNLSEGIREWWDLKPGAPKPKANQQKQDDGRGLVLPGYK
YLGPFNGLDKGEPVNAADAAALEHDKAYDQQLKAGDNPYLRYNHADAEFQE
RLQEDTSFGGNLGRAVFQAKKRVLEPLGLVEEGANTAPGKKRPVEQSPQEP
DSSSGIGKTGQQPAKKRLNFGQTGDSESVPDPQPLREPPAAPSGLGPNTMA
SGGGAPMADNNEGADGVGNSSGNWHCDSTWLGDRVITTSTRTWALPTYNNH
LYKQISNGTSGGSTNDNTYFGYSTPWGYFDFNRFHCHFSPRDWQRLINSNW
GFRPKRLNFKLFNIQVKEVTTNEGTKTIANNLTSTVQVFTDSEYQLPYVLG
SAHQGCLPPFPADVFMVPQYGYLTLNNGSQALGRSSFYCLEYFPSQMLRTG
NNFQFSYTFEDVPFHSSYAHSQSLDRLMNPLIDQYLYYLVRTQTTGTGGTQ
TLAFSQAGPSSMANQARNWVPGPCYRQQRVSTTTNQNNNSNFAWTGAAKFK
LNGRDSLMNPGVAMASHKDDEDRFFPSSGVLIFGKQGAGNDGVDYSQVLIT
DEEEIKATNPVATEEYGAVAINNQAANTQAQTGLVHNQGVIPGMVWQNRDV
YLQGPIWAKIPHTDGNFHPSPLMGGFGLKHPPPQILIKNTPVPADPPLTFN
QAKLNSFITQYSTGQVSVEIEWELQKENSKRWNPEIQYTSNYYKSTNVDFA
VNTEGVYSEPRPIGTRYLTRNL

The VP1 sequence of a novel AAV capsid isolated from pig (denoted as Bpo.1) is set out as SEQ ID NO:53 (amino acids 1-716) and the locations of the associated variable regions and GBS and GH loop regions are defined in Table 2 below. The VP2 capsid protein spans amino acids 137-716 of SEQ ID NO:53 and the VP3 capsid protein spans amino acids 184-716 of SEQ ID NO:53.

MSFVDHPPDWLEEIGEGLKEFLGLEPGPPKPKPNQQKQDNARG
LVLPGYNYLGPGNGLDRGEPVNRADEVAREHDISYNEQLQAGD
NPYLKYNHADAEFQEKLADDTSFGGNLGKAVFQAKKRVLEPFG
LVEEPAKTAAKGERIDDHYPKKKKARVEE7EAGTSGGQQLQIP
AQPASSLGADTMSAGGGSPLGDNNQGADGVGNASGDWHCDSTW
MGDRVITKSTRTWVLPSYNNHLYKEIHSGSVDGSNANAYFGYS
TPWGYFDFNRFHSHWSPRDWQRLVNNYWGFRPRSLKVKIFNIQ
VKEVTVQDATTTIANNLTSTVQVFTDDDYQLPYVIGNGTEGCL
PAFPPQVFTLPQYGYATLNRNNTDDPTERSSFFCLEYFPSKML
RTGNSFEFTYSFEEVPFHCSFAPSQNLFKLANPLVDQYLYRFV
STDTSGNIQFQKNLKARYANTYKNWFPGPMCRTQGWYTGSGTY
NRSGVTNFATSNRMDLEGASYQVNPQPNGMTNTLQDSNKYALE
NTMIFNSQNAEPGTTSLYQENNLLITSESETQPVNRVAYDTGG
QMATNAQSTNLAPTVGTYNHQEMLPGSVWMDRDVYLQGPIWAK
IPETGAHFHPSPAMGGFGLKHPPPMMLIKNTPVPSNVTAFSEI
PVKSFITQYSTGQVTVEMEWELKKEDSKRWNPEIQYTNNYNNP
EFVDFAPDTSGEYRTTRAIGTRYLTRPL

The VP1 sequence of a novel AAV capsid isolated from pig (denoted as Bpo.2) is set out as SEQ ID NO:54 (amino acids 1-716) and the locations of the associated variable regions and GBS and GH loop regions are defined in Table 2 below. The VP2 capsid protein spans amino acids 137-716 of SEQ ID NO:54 and the VP3 capsid protein spans amino acids 184-716 of SEQ ID NO:54.

```
MSFVDHPPDWLEEIGEGLKEFLGLEPGPPKPXPNQQKQDNARG
LVLPGYNYLGPGNGLDRGEPVNRADEVAREHDISYNEQLQAGD
NPYLKYNHADAEFQEKLADDTSFGGNLGKAVFQAKKRALEPFG
LVEEPAKTAAKGERIDDHYPKKKKARVEETEAGTSGGQQLQIP
AQPASSLGADTMSAGGGSPLGDNNQGADGVGNASGDWHCDSTW
MGDRVITKSTRTWVLPSYNNHLYKEIHSGSVDGSNANAYFGYS
TPWGYFDFNRFHSHWSPRDWQRLVNNYWGFRPRSLKVKIFNIQ
VKEVTVQDATTTIANNLTSTVQVFTDDDYQLPYVIGNGTEGCL
PAFPPQVFTLPQYGYATLNRNNTDDPTERSSFFCLEYFPSKML
RTGNSFEFTYSFEEVPFHCSFAPSQNLFKLANPLVDQYLYRFV
GTDTSGNIQFQKNLKARYANTYKNWFPGPMCRTQGWYTGSGTY
NRSGVTNFATSNRMDLEGASYQVNPQPNGMTNTLQDSNKYALE
NTMIFNSQNAEPGTTSLYQENNLLITSESETQPVNRVAYDTGG
QMATNAQSTNLAPTVGTYNHQEMLPGSVWMDRDVYLQGPIWAX
IPETGAHFHPSPAMGGFGLKHPPPMMLIKNTPVPSNVTAFSEI
PVKSFITQYSTGQVTVEMEWELKKENSKRWNPEIQYTNNYNNP
EFVDFAPDTSGEYRTTRAIGTRYLTRPL
```

The VP1 sequence of a novel AAV capsid isolated from pig (denoted as Bpo.3) is set out as SEQ ID NO:55 (amino acids 1-716) and the locations of the associated variable regions and GBS and GH loop regions are defined in Table 2 below. The VP2 capsid protein spans amino acids 137-716 of SEQ ID NO:55 and the VP3 capsid protein spans amino acids 184-716 of SEQ ID NO:55.

```
MSFVDHPPDWFEEIGEGLKEFLGLEPGPPKPKPNQQKQDNARG
LVLPGYNYLGPGNGLDRGEPANRADEVAREHDISYNEQLQAGD
NPYLKYNHADAEFQEKLADDTSFGGNLGKAVFQAKKRVLEPFG
LVEEPAKTAAKGERIDDHYPKKKKARVEETEAGTSGGQQLQIP
AQPASSLGADTMSAGGGSPLGDNNQGADGVGNASGDWHCDSTW
MGDRVITKSTRTWVLPSYNNHLYKEIHSGSVDGSNANAYFGYS
TPWGYFDFNRFHSHWSPRDWQRLVNNYWGFRPRSLKVKIFNIQ
VKEVTVQDATTTIANNLTSTVQVFTDDDYQLPYVIGNGTEGCL
PAFPPQVFTLPQYGYATLNRNNTDDPTERSSFFCLEYFPSKML
RTGNSFEFTYSFGEVPLHCSFAPSQNLFKLANPLVDQHLYRFV
STDTSGNIQFQKNLKARYANTYKNWFPGPMCRTQGWYTGSGTY
NRPGVTNFATSNRMDLEGASYQVNPQPNGMTNTLQDSNKYALE
NTMIFNSQNAEPGTTSLYQENNLLITSESETQPVNRVAYDTGG
QMATNAQSTNLAPTVGTYNHQEMLPGSVWMDRDVYLQGPIWAK
IPETGAHFHPSPAMGGFGLKHPPPMMLTKNTPVPSNVTAFSEI
PVKSFITQYSTGQVTVEMEWELKKENSKRWNPEIQYTNNYNNP
EFVDFAPDTSGEYRTTRAIGTRYLTRPL
```

The VP1 sequence of a novel AAV capsid isolated from pig (denoted as Bpo.4) is set out as SEQ ID NO:56 (amino acids 1-716) and the locations of the associated variable regions and GBS and GH loop regions are defined in Table 2 below. The VP2 capsid protein spans amino acids 137-716 of SEQ ID NO:56 and the VP3 capsid protein spans amino acids 184-716 of SEQ ID NO:56.

```
MSFVDHPPDWLEEIGEGLKEFLGLEPGPPKPKPNQQKQDNARG
LVLPGYNYLGPGNGLDRGEPVNRADEVAREHDISYNEQLQAGD
NPYLKYNHADAEFQEKLADDTSFGGNLGKAVFQAKKRVLEPFG
LVEEPAKTAAKGERIDDHYPKKKKARVEETEAGTSGGQQLQIP
AQPASSLGADTMSAGGGSPLGDNNQGADGVGNASGDWHCDSTW
MGDRVITKSTRTWVLPSYNNHLYKEIHSGSVDGSNANAYFGYS
TPWGYFDFNRFHSHWSPRDWQRLVNNYWGFRPRSLKVKIFNIQ
VKEVTVQDATTTIANNLTSTVQVFTDDDYQLPYVIGNGTEGCL
PAFPPQVFTLPQYGYATLNRNNTDDPTERSSFFCLEYFPSKML
RTGNSFEFTYSFEEVPFHCSFAPSQNLFKLANPLVDQYLYRFV
STDTSGNIQFQKNLKARYANTYKNWFPGPMCRTQGWYTGSGTY
NRSGVTNFATSNRMDLEGASYQVNPQPNGMTNTLQDSNKYALE
NTMIFNSQNAEPGTTSLYQENNLLITSESETQPVNRVAYDTGG
QMATNAQSTNLAPTVGTYNHQEMLPGSVWMDRDVYLQGPIWAK
IPETGAHFHPSPAMGGFGLKHPPPMMLIKNTPVPSNVTAFSEI
PVKSFITQYSTGQVTVEMEWELKKENSKRWNPEIQYTNNYNNP
EFVDFAPDTSGEYRTTRAIGTRYLTRPL
```

The VP1 sequence of a novel AAV capsid isolated from pig (denoted as Bpo.6) is set out as SEQ ID NO:57 (amino acids 1-716) and the locations of the associated variable regions and GBS and GH loop regions are defined in Table 2 below. The VP2 capsid protein spans amino acids 137-716 of SEQ ID NO:57 and the VP3 capsid protein spans amino acids 184-716 of SEQ ID NO:57.

```
MSFVDHPPDWLEEIGEGLKEFLGLEPGPPKPKPNQQKQDNARG
LVLPGYNYLGPGNGLDRGEPVNRADEVAREHGISYNEQLQAGD
DPYLKYNHADASFQEKLADDTSFGGNLGKAVFQAKKRVLEPFG
LVEEPAKTAAKGERIDDHYPKKKKARVEETEAGTGGGQQLQIP
AQPASSLGADTMSAGGGSPLGDNNQGADGVGNASGDWHCDSTW
MGDRVITKSTRTWVLPSYNNHLYKEIHSGSVDGSNANAYFGYS
TPWGYFDFNRFHSHWSPRDWQRLVNNYWGFRPRSLKVKIFNIQ
VKEVTVQDATTTIANNLTSTVQVFTDDDYQLPYVIGNGTEGCL
PAFPPQVFTLPQYGYATLNRNNTDDPTERSSFFCLEYFPSKML
RTGNSLEFTYSFEEVPFHCSFAPSQNLFKLANPLVDQYLYRFV
STDTSGNIQFQKNLKARYANTYKNWFPGPMCRTQGWYTGSGTY
NRSGVTNFATSNRMDLEGASYQVNPQPNGMTNTLQDSNKYALE
```

NTMIFNSQNAEPGTTSLYQENNLLITSESETQPVNRVAYDTGG

QMATNAQSTNLAPTVGTYNHQEMLPGSVWMDRDVYLQGPIWAK

IPETGAHFHPSPAMGGFGLKHPPPMMLIKNTPVPSNVTAFSEI

PVKSFITQYSTGQVTVEMEWELKKENSKRWNPEIQYTNNYNNP

EFVDFAPDTSGEYRTTRAIGTRYLTRPL

The VP1 sequence of a novel AAV capsid isolated from pig (denoted as Bpo.8) is set out as SEQ ID NO:58 (amino acids 1-716) and the locations of the associated variable regions and GBS and GH loop regions are defined in Table 2 below. The VP2 capsid protein spans amino acids 137-716 of SEQ ID NO:58 and the VP3 capsid protein spans amino acids 184-716 of SEQ ID NO:58.

MSFVDHPPDWLEEIG2GLKEFLGLKPGPPKPKPNQQKQDNARG

LVLPGYNYLGPGNGLGRGEPVNRADEVAREHDISYNEQLQAGD

NPYLKYNHADAEFQEKLADDTSFGGNLGKAVFQAKKRVLEPFG

LVEEPAKTAAKGERIDDHYPKKKKARVEETEAGTSGGQQLQIP

AQPASSLGADTMSAGGGSPLGDNNQGADGVGNASGDWHCDSTW

MGDRVITKSTRTWVLPSYNNHLYKEIHSGSVDGSNANAYFGYS

TPWGYFDFNRFHSHWSPRDWQRLVNNYWGFRPRSLKVKIFNIQ

VKEVTVQDATTTIANNLTSTVQVFTDDDYQLPYVIGNGTEGCL

PAFPPQVFTLPQYGYATLNRNNTDDPTERSSFFCLEYFPSKML

RTGNSFEFTYSFEEVPFHCSFAPSQNLFKLANPLVDQYLRFV

STDTSGNIQFQKNLKARYANTYKNWFPGPMCRTQGWYTGSGTY

NRSGVTNFATSNRMDLEGASYQANPQPNGMTNTLQDSNKYALE

NTMIFNSQNAEPGTTSLYQENNLLITSESETQPVNRVAYDTGG

QMATNAQSTNLAPTVGTYNHQEMLPGSVWMDRDVYLQGPIWAK

IPETGAHFHPSPAMGGFGLKHPPPMMLIKNTPVPSNVTAFSEI

PVKSLITQYSTGQVTVEMEWELKKENSKRWNPEIQYTNNYNNP

EFVDFAPDTSGEYRTTRAIGTRYLTRPL

The VP1 sequence of a novel AAV capsid isolated from pig (denoted as Bpo.13) is set out as SEQ ID NO:59 (amino acids 1-716) and the locations of the associated variable regions and GBS and GH loop regions are defined in Table 2 below. The VP2 capsid protein spans amino acids 137-716 of SEQ ID NO:59 and the VP3 capsid protein spans amino acids 184-716 of SEQ ID NO:59.

MSFVDHPPDWLEEIGEGLKEFLGLEPGPPKPKPNQQKQDNARG

LVLPGYNYLGPGNGLDRGEPVNRADEVAREHDISYNEQLQAGD

NPYLKYNHADAEFQEKLADDTSFGGNLGKAVFQAKKRVLEPFG

LVEEPAKTAAKGERIDDHYPKKKKARVEETEAGTSGGQQLQIP

AQPASSLGADTMSAGGGSPLGDNNQGADGVGNASGDWHCDSTW

MGDRVITKSTRTWVLPSYNNHLYKEIHSGSVDGSNANAYFGYS

TPWGYFDFNRFHSHWSPRDWQRLVNNYWGFRPRSLKVKIFNIQ

VKEVTVQDATTTIANNLASTVQVFTDDDYQLPYVIGNGTEGCL

PAFPPQVFTLPQYGYATLNRNNTDDPTERSSFFCLEYFPSKML

RTGNSFEFTYSFEEVPFHCSFAPSQNLFKLANPLVDQYLRFV

STDTSGNIQFQKNLKARYANTYKNWFPGPMCRTQGWYTGSGTY

NRSGVTNFATSNRMDLEGASYQVNPQPNGMTNTLQDSNKYALE

NTMIFNSQNAEPGTTSLYQENNLLITSESETQPVNRVAYDTGG

QMATNAQSTNLAPTVGTYNHQEMLPGSVWMDRDVYLQGPIWAK

IPETGAHFHPSPAMGGFGLKHPPPMMLIKNTPVPSNVTAFSEI

PVKSFITQYSTGQVTVEMEWELKKENSKRWNPEIQYTNNYNNP

EFVDFAPDTSGEYRTTRAIGTRYLTRPL

The VP1 sequence of a novel AAV capsid isolated from pig (denoted as Bpo.18) is set out as SEQ ID NO:60 (amino acids 1-716) and the locations of the associated variable regions and GBS and GH loop regions are defined in Table 2 below. The VP2 capsid protein spans amino acids 137-716 of SEQ ID NO:60 and the VP3 capsid protein spans amino acids 184-716 of SEQ ID NO:60.

MSFVDHPPDWLEEIGEGLKEFLGLEPGPPKPKPNQQKQDNARG

LVLPGYNYLGPGNGLDRGEPVNRADEVAREHDISYNEQLQAGD

DPYLKYNHADAEFQEKLADDTSFGGNLGKAVFQAKKRVLEPFG

LVEEPAKTAAKGERIDDHYPKKKKARVEETEAGTSGGQQLQIP

AQPASSLGADTMSAGGGSPLGDNNQGADGVGNASGDWHCDSTW

MGDRVITKSTRTWVLPSYNNHLYKEIHSGSVDGSNANAYFGYS

TPWGYFDFNRFHSHWSPRDWQRLVNNYWGFRPRSLKVKIFNIQ

VKEVTVQDATTTIANNLTSTVQVFTDDDYQLPYVIGNGTEGCL

PAFPPQVFTLPQYGYATLNRNNTDDPTERSSFFCLEYFPSKML

RTGNSFEFTYSFEEVPFHCSFAPSQNLFKLANPLVDQYLRFV

STDTSGNIQFQKNLKARYANTYKNWFPGPMRRTQGWYTGSGTY

NRSGVTNFATSNRMDLEGASYQVNPQPNGMTNTLQDSNKYALE

NTMIFNSQNASPGTTSLYQENNLLITSESETQPVNRVAYDTGG

QMATNAQSTNLAPTVGTYNHQEMLPGSVWMDRDVYLQGPIWAK

IPETGAHFHPSPAMGGFGLKHPPPMMLIKNTPVPSNVTAFSEI

PVKSFITQYSTGQVTVEMEWELKKENSKRWNPEIQYTNNYNNP

EFVDFAPDTSGEYRTTRAIGTRYLTRPL

The VP1 sequence of a novel AAV capsid isolated from pig (denoted as Bpo.20) is set out as SEQ ID NO:61 (amino acids 1-716) and the locations of the associated variable regions and GBS and GH loop regions are defined in Table 2 below. The VP2 capsid protein spans amino acids 137-716 of SEQ ID NO:61 and the VP3 capsid protein spans amino acids 184-716 of SEQ ID NO:61.

MSFVDHPPDWLEEIGSGLKEFLGLEPGPPKPKPNQQKQDNARG

LVLPGYNYLGPGNGLDRGEPVNRADEVAREHDISYNEQLQAGD

NPYLKYNHADAEFQEXLADDTSFGGNLGKAVFQAKKRVLEPFG

```
LVEEPAKTAAKGERIDDHYPKKKKARVEE7EAGTSGGQQLQIP

AQPASSLGADTMSAGGGSPLGDNNQGADGVGNASGDWHCDSTW

MGDRVITKSTRTWVLPSYNNHLYKEIHSGSVDGSNANAYFGYS

TPWGYFDFNRFHSHWGPRDWQRLVNNYWGFRPRSLKVKIFNIQ

VKEVTVQQATTTIANNLTSTVQVFTDDDYQLPYVIGNGTEGCL

PAFPPQVFTLPQYGYATLNRNNTDDPTERSSFFCLEYFPSKML

RTGNSFEFTYSFEGVPFHCSFAPSQNLFKLANPLVDQYLYRFV

STDTSGNIQFQKNLKARYANTYKNWFPGPMCRTQGWYTGSGTY

NRSGVTNFATSNRMDLEGASYQVNPQPNGMTNTLQDSNKYALE

NTMIFNSQNAEPGTTSLYQENNLLITSESETQPVNRVAYDTGG

QMATNAQSTNLAPTVGTYNHQEMLPGSVWMDRDVYLQGPIWAK

IPETGAHFHPSPAMGGFGLKHPPPMMLIKNTPVPSNVTAFSEI

PVKSFITQYSTGQVTVEMEWELKKENSKRWNPEIQYTNNYNNP

EFVDFAPDTSGEYRTTRAIGTRYLTRPL
```

The VP1 sequence of a novel AAV capsid isolated from pig (denoted as Bpo.23) is set out as SEQ ID NO:62 (amino acids 1-716) and the locations of the associated variable regions and GBS and GH loop regions are defined in Table 2 below. The VP2 capsid protein spans amino acids 137-716 of SEQ ID NO:62 and the VP3 capsid protein spans amino acids 184-716 of SEQ ID NO:62.

```
MSFVDHPPDWLEEIGEGLKEFLGLEPGPPKPKPNQQKRDNARG

LVLPGYNYLGPGNGLDRGEPVNRVDEVARERDISYNEQLQAGD

NPYLKYNHADAEFQEKLADDTSFGGNLGKAVFQAKKRVLEPFG

LVEEPAKTAAKGERIDDHYPKKKKARVEETEAGTSGGQQLQIP

AQPASSLGADTMSAGGGSPLGDNNQGADGVGNASGDWHCDSTW

MGDRVITKSTRTWVLPSYNNHLYKEIHSGSVDGSNANAYFGYS

TPWGYFDFNRFHSHWSPRDWQRLVNNYWGFRPRSLKVKIFNIQ

VKEVTVQDATTTIANNLTSTVQVFTDDDYQLPYVIGNGTEGCL

PAFPLQVFTLPQYGYATLNRNNTDDPTERSSFFCLEYFPSKML

RTGNSFEFTYSFEEVPFHCSFAPSQNLFKLANPLVDQYLYRFV

STDTSGNIQFQKNLKARYANTYKNWFPGPMCRTQGWYTGSGTY

NRSGVTNFATSNRMDLEGASYQVNPQPNGMTNTLQDSNKYALS

NTMIFNSQNAEPGTTSLYQENNLLITSESETQPVNRVAYDTGG

QMATNAQSTNLAPTVGTYNHQEMLPGSVWMDRDVYLQGPIWAK

IPETGAHFHPSPAMGGFGLKHPPPMMLIKNTPVPSNVTAFSEI

PVKSFITQYSTGQVTVEMEWELKKENSKRWNPEIQYTNNYNNP

EFVDFAPDTSGEYRTTRAIGTRYLTRPL
```

The VP1 sequence of a novel AAV capsid isolated from pig (denoted as Bpo.24) is set out as SEQ ID NO:63 (amino acids 1-716) and the locations of the associated variable regions and GBS and GH loop regions are defined in Table 2 below. The VP2 capsid protein spans amino acids 137-716 of SEQ ID NO:63 and the VP3 capsid protein spans amino acids 184-716 of SEQ ID NO:63.

```
MSFVDHPPDWLEEIGEGLKEFLGLEPGPPKPKPNQQKQDNARG

LVLPGYNYLGPGNGLDRGEPVNRADEVAREHDISYNEQLQAGD

NPYLKYNHADAEFQEKLADDTSFGGNLGKAVFQAKKRVLEPFG

LVEEPAKTAAKGERIDDHYPKKKKARVEETEAGTSGGQQLQIP

AQPASSLGADTMSAGGGSPLGDNNQGADGVGNASGDWHCDSTW

MGDRVITKSTRTWVLPSYNNHLYKEIHSGSVDGSNANAYFGYS

TPWGYFDFNRFHSHWSPRDWQRLVNNYWGFRPRSLKVKIFNIQ

VKEVTVQDATTTIANNLTSTVQVFTDDDYQLPYVIGNGTEGCL

PAFPPQVFTLPQYGYATLNRNNTDDPTERSSFFCLEYFPSKML

RTGNSFEFTYSFEEVPFHCSFAPSQNLFKLANPLVDQYLYRFV

STDTSGNIQFQKNLXARYANTYKNWFPGPMCRTQGWYTGSGTY

NRSGVTNFATSNRMDLEGASYQVNPQPNGMTNTLQDSNKYALE

NTMIFNSQNAEPGTTSLYQENNLLITSESETQPVNRVAYDTGG

QMATNAQSTNLAPTVGTYNHQ2MLPGSVWMDRDVYLQGP1WAX

IPETGAHFHPSPAMGGFGLKHPPPMMLIKNTPVPSNVTAFSEI

PVKSFITQYSTGQVTVEMEWELKKENSKRWNPEIQYTNNYNNP

EFVDFAPDTSGECRTTRAIGTRYLTRPL
```

The VP1 sequence of a novel AAV capsid isolated from pig (denoted as Bpo.27) is set out as SEQ ID NO:64 (amino acids 1-716) and the locations of the associated variable regions and GBS and GH loop regions are defined in Table 2 below. The VP2 capsid protein spans amino acids 137-716 of SEQ ID NO:64 and the VP3 capsid protein spans amino acids 184-716 of SEQ ID NO:64.

```
MSFVDHPPDWLEEIGEGLKEFLGLEPGPPKPKPNQQKQDNARG

LVLPGYNYLGPGNGLDRGEPVNRADEVAREHDISYNEQLQAGD

NPYLKYNHADAEFQEKLADDTSFGGNLGKAVFQAKKRVLEPFG

LVEEPAKTAAKGERIDDHYPKKKKARVEETEAGTSGGQQLQIP

AQPASSLGADTMSAGGGSPLGDNNQGADGVGNASGDWHCDSTW

MGDRVITKSTRTWVLPSYNNHLYKEIHSGSVDGSNANAYFGYS

TPWGYFDFNRFHSHWSPRDWQRLVDNYWGFRPRSLKVKIFNIQ

VKEVTVQDATTTIANNLTSTVQVFTDDDYQLPYVIGNGTEGCL

PAFPPQVFTLPQYGYATLNRNNTDDPTERSSFFCLEYFPSKML

RTGNSFEFTYSFEEVPFHCSFAPSQNLFKLANPLVDQYLYRFV

STDTSGNIQFQKNLKARYANTYKNWFPGPMCRTQGWYTGSGTY

NRSGVTNFATSNRMDLEGASYQVNPQPNGMTNTLQDSNKYALE

NTMVFNSQNAEPGTTSLYQENNLLITSESETQPVNRVAYNTGG

QMATNAQSTNLAPTVGTYNHQEMLPGSVWMDRDVYLQGPIWAK

IPETGAHFHPSPAMGGFGLKHPPPMMLIKNTPVPSNVTAFSEI

PVKSFITQYSTGQVTVEMEWELKKENSKRWNPEIQYTNNYNNP

EFVDFAPDTSGEYRTTRAIGTRYLTRPL
```

The VP1 sequence of a novel AAV capsid isolated from pig (denoted as Bpo.28) is set out as SEQ ID NO:65 (amino acids 1-716) and the locations of the associated variable regions and GBS and GH loop regions are defined in Table 2 below. The VP2 capsid protein spans amino acids 137-716 of SEQ ID NO:65 and the VP3 capsid protein spans amino acids 184-716 of SEQ ID NO:65.

```
MSFVDHPPDWLEEIGEGLKEFLGLEPGPPKPKPNQQKRDNARG
LVLPGYNYLGPGNGLGREPVNRADEVAREHDISYNEQLQAGD
NPYLKYNHADASFQEKLADDTSFGGNLGKAVFQAKKRVLEPFG
LVEEPAKTAAKGERIDDHYPKKKKARVEETEAGTSGGQQLQIP
AQPASSLGADTMSAGGGSPLGDNNQGADGVGNASGDWHCDSTW
MGDRVITKSTRTWVLPSYNNHLYKEIHSGSVDGSNANAYFGYS
TPWGYFDFNRFHSHWSPRDWQRLVNNYWGLRPRSLKVKIFNIQ
VKEVTVQDATTTIANNLTSTVQVFTDDDYQLPYVIGNGTEGCL
PAFPPQVFTLPQYGYATLNRNNTDDPTERSSFFCLEYFPSKML
RTGNSFEFTYSFEEVPFHCSFAPSQNLFKLANPLADQYLYRFV
STDTSGNIQFQKNLKARYANTYKNWFPGPMCRTQGWYTGSGTY
NRSGVTNFATSNRMDLEGASYQVNPQPNGMTNTLQDSNKYALE
NTMISNSQNASPGTTSLYRENNLLITSESETQPVNRVAYDTGG
QMATNAQSTNLAPTVGTYNHQEMLPGSVWMDRDVYLQGPIWAX
IPETGAHFHPSPAMGGFGLKHPPPMMLIKNTPVPSNVTAFSEI
PVKSFITQYSTGQVTVEMEWELKKENSKRWNPEIQYTNNYNNP
EFVDFAPDTSGEYRTTRAIGTRYLTRPL
```

The VP1 sequence of a novel AAV capsid isolated from pig (denoted as Bpo.29) is set out as SEQ ID NO:66 (amino acids 1-716) and the locations of the associated variable regions and GBS and GH loop regions are defined in Table 2 below. The VP2 capsid protein spans amino acids 137-716 of SEQ ID NO:66 and the VP3 capsid protein spans amino acids 184-716 of SEQ ID NO:66.

```
MSFVDHPPDWLSEIGEGLKEFLGLEPGPPKPKPNQQKQDNARG
LVLPGYNYLGPGNGLDRGEPVNRADEVAREHDISYNEQLQAGD
NPYLKYNHADAEFQEKLADDTSFGGNLGKAVFQAKKRVLEPFG
LVEEPAKTAAKGERIDDHYPKKKKARVEETEAGTSGGQQLQIP
AQPASSLGADTMSAGGGSPLGDNNQGADGVGNASGDWHCDSTW
MGDRVITKSTRTWVLPSYNNHLYKEIHSGSVDGSNANAYFGYS
TPWGYFDFNRFHSHWSPRDWQRLVNNYWGFRPRSLKVKIFNIQ
VKEVTVQDATTTIANNLTSTVQVFTDDDYQLPYVIGNGTEGCL
PAFPPQVFTLPQYGYATLNRNNTDDPTERSSFFCLEYFPSKML
RTGNSFEFTYSFEEVPFHCSFAPSQNLFKLANPLVDQYLYRFV
STDTSGNIQFQKNLKARYANTYKNWFPGPMCRTQGWYTGSGTY
NRSGVTNFATSNRMDLEGASYQVNPQPNGMTNTLQDSNKYALE
NTMIFNSQNAEPGTTSLYQENNLLITSESGTQPVNRVAYDTGG
QMATNAQSTNLAPTVGTYNHQEMLPGSVWMDRGVYLQGPIWAK
IPETGAHFHPSPAMGGFGLKHPPPMMLIKNTPVPSNVTAFSEI
PVKSFVTQYSTGQVTVEMEWELKKENSKRWNPEIQYTNNYNNP
EFVDFAPDTSGEYRTTRAIGTRYLTRPL
```

The VP1 sequence of a novel AAV capsid isolated from pig (denoted as Bpo.33) is set out as SEQ ID NO:67 (amino acids 1-716) and the locations of the associated variable regions and GBS and GH loop regions are defined in Table 2 below. The VP2 capsid protein spans amino acids 137-716 of SEQ ID NO:67 and the VP3 capsid protein spans amino acids 184-716 of SEQ ID NO:67.

```
MSFVDHPPDWLEEIGEGLKEFLGLEPGPPKPKPNQQKQDNARG
LVLPGYNYLGPGNGLDRGEPVNRADEVAREHDISYNEQLQAGD
NPYLKYNHADAEFQEKLADDTSFGGNLGKAVFQAKKRVLEPFG
LVEEPAKTAAKGERIDDHYPKKKKARVEETEAGTSGGQQLQIP
AQPASSLGADTMSAGGGSPLGDNNQGADGVGNASGDWHCDSTW
MGDRVITKSTRTWVLPSYNNHLYKEIHSGSVDGSNAHAYFGYS
TPWGYFDFNRFHSHWSPRDWQRLVNNYWGFRPRSLKVKIFNIQ
VKEVTVQDATTTIANNLTSTVQVFTDDDYQLPYVIGNGTEGCL
PAFPPQVFTLPQYGYATLNRNNTDDPTERSSFFCLEYFPSKML
RTGNSFEFTYSFEEVPFHCSFAPSQNLFKLANPLVDQYLYRFV
STDTSGNIQFQKNLKARYANTYKNWFPGPMCRTQGWYTGSGTY
NRSGVTNFATSNRMDLEGASYQVNPQPNGMTNTLQDSNKYALE
NTMIFNSQNAEPGTTSLYQENNLLITSESETQPVNRVAYDTGG
QMATNAQSTNLAPTVGTYNHQEMLPGSVWMDRDVYLQGPIWAK
IPETGAHFHPSPAMGGFGLKHPPPMMLIKNTPVPSNVTAFSEI
PVKSFITQYSTGQVTVEMEWELKKENSKRWNPEIQYTNNYNNP
EFVDFAPDTSGEYRTTRAIGTRYLTRPL
```

The VP1 sequence of a novel AAV capsid isolated from pig (denoted as Bpo.35) is set out as SEQ ID NO:68 (amino acids 1-716) and the locations of the associated variable regions and GBS and GH loop regions are defined in Table 2 below. The VP2 capsid protein spans amino acids 137-716 of SEQ ID NO:68 and the VP3 capsid protein spans amino acids 184-716 of SEQ ID NO:68.

```
MSFVDHPPDWLEEIGEGLKEFLGLEPGPPKPKPNQQKRDNARGLVLPGYNY
LGPGNGLDRGEPVNRADEVAREHDISYNEQLQAGDNPYLKYNHADAEFQEK
LADDTSFGGNLGKAVFQAKKRVLEPFGLVEEPAKTAAKGERIDDHYPKKKK
ARVEETEAGTSGGQQLQIPAQPASSLGADTMSAGGGSPLGDNNQGADGVGN
ASGDWHCDSTWMGDRVITKSTRTWVLPSYNNHLYKEIHSGSVDGSNANAYF
GYSTPWGYFDFNRFHSHWSPRDWQRLVNNYWGFRPRSLKVKIFNIQVKEVT
VQDATTTIANNLTSTVQVFTDDDYQLPYVIGNGTEGCLPAFPPQVFTLPQY
GYATLNRNNTDDPTERSSFFCLEYFPSKMLRTGNSFEFTYSFEEVPFHCSF
APSQNLFKLANPLVDQYLYRFVSTDTSGNIQFQKNLKARYANTYKNWFPGP
MCRTQGWYTGSGTYNRSGVTNFATSNRMDLEGASYQVNPQPNGMTNTLQDS
NKYALENTMIFNSQNAEPGTTSLYQENNLLITSESETQPVNRVAYDTGGQM
```

ATNAQSTNLAPTVGTYNHQEMLPGSVWMDRDVYLQGPIWAKIPETGAHFHP

SPANGGFGLKHPPPMMLIKNTPVPSNVTAFSEIPVKSFITQYSTGQVTVEM

EWELKKENSKRWNPEIQYTNNYNNPEFVGFAPDTSGEYRTTRAIGTRYLTR

PL

The VP1 sequence of a novel AAV capsid isolated from pig (denoted as Bpo.36) is set out as SEQ ID NO:69 (amino acids 1-716) and the locations of the associated variable regions and GBS and GH loop regions are defined in Table 2 below. The VP2 capsid protein spans amino acids 137-716 of SEQ ID NO:69 and the VP3 capsid protein spans amino acids 184-716 of SEQ ID NO:69.

MSFVDHPPDWLEEIGEGLKEFLGLEPGPPKPKPNQQKQDNARGLVLPGYNY

LGPGNGLDRGEPVNRADEVAREHDISYNEQLQAGDNPYLKYNHADAEFQEK

LADDTSFGGNLGKAVFQAKKRVLEPFGLVEEPAKTAAKGERIGDHYPKKKK

ARVEETEAGTSGGQQPQIPAQPASSLGADTMSAGGGSPLGDNNQGADGVGN

ASGDWHCDSTWMGDRVITKSTRTWVLPSYNNHLYKEIHSGSVDGSNANAYF

GYSTPWGYFDFNRFHSHWSPRDWQRLVNNYWGFRPRSLKVKIFNIQVKEVT

VQDATTTIANNLTSTVQVFTDDDYQLPYVIGNGTEGCLPAFPPQVFTLPQY

GYATLNRNNTDDPTERSSFFCLEYLPSKMLRTGNSFEFTYSFEEVPFHCSF

APSQNLFKLANPLVDQYLYRFVSTDTSGNIQFQKNLKARYANTYKNWFPGP

MCRTQGWYTGSGTYNRSGVTNFATSNRMDLEGASYQVNPQPNGMTNTLQDS

NKYALENTMIFNSQNAEPGTTSLYQENNLLITSESETQPVNRVAYNTGGQM

ATNAQSTNLAPTVGTYNHQEMLPGSVWMDRDVYLQGPIWAKIPETGAHFHP

SPANGGFGLKHPPPMMLIKNTPVPSNVTAFSEIPVKSFITQYSTGQVTVEM

EWELKKENSKRWNPEIQYTNNYNNPEFVDFAPDTSGEYRTTRAIGTRYLTR

PL

The VP1 sequence of a novel AAV capsid isolated from pig (denoted as Bpo.37) is set out as SEQ ID NO:70 and (amino acids 1-716) and the locations of the associated variable regions and GBS and GH loop regions are defined in Table 2 below. The VP2 capsid protein spans amino acids 137-716 of SEQ ID NO:70 and the VP3 capsid protein spans amino acids 184-716 of SEQ ID NO:70.

MSFVDHPPDWLEEIGEGLKEFLGLKPGPLKPKPNQQKQDNARGLVLPGYNY

LGPGNGLDRGEPVNRADEVAREHDISYNEQLQAGDNPYLKYNHADAEFQEK

LADDTSFGGNLGKAVFQAKKRVLEPFGLVEEPAKTAAKGERIDDHYPKKKK

ARVEETEAGTSGGQQLQIPAQPASSLGADTMSAGGGSPLGDNNQGADGVGN

ASGDWHCDSTWMGDRVITKSTRTWVLPSYNNHLYKEIHSGSVDGSNANAYF

GYSTPWGYFDFNRFHSHWSPRDWQRLVNNYWGFRPRSLKVKIFNIQVKEVT

VQDATTTIANNLTSTVQVFTDDDYQLPYVIGNGTEGCLPAFPPQVFTLPQY

GYATLNRNNTDDPTERSSFFCLEYLPSKMLRTGNSFEFTYSFEEVPFHCSF

APSQNLFKLANPLVDQYLYRFVSTDTPGNIQFQKNLKARYANTYKNWFPGP

MCRTQGWYTGSGTYNRSGVTNFATSNRMDLEGASYQANPQPNGMTNTLQDS

NKYALENTMIFNSQNAEPGTTSLYQENNLLITSESETQPVNRVAYDTGGQM

ATNAQSTNLAPTVGTYNHQEMLPGSVWMDRDVYLQGPIWAKIPETGAHFHP

SPANGGFGLKHPPPMMLIKNTPVPSNVTAFSEIPVKSLITQYSTGQVTVEM

EWELKKENSKRWNPEIQYTNNYNNPEFVDFAPDTSGEYRTTRAIGTRYLTR

PL

The VP1 sequence of a novel AAV capsid isolated from rhesus macaque (denoted as Brh.26) is set out as SEQ ID NO:71 and (amino acids 1-736) and the locations of the associated variable regions and GBS and GH loop regions are defined in Table 2 below. The VP2 capsid protein spans amino acids 138-736 of SEQ ID NO:71 and the VP3 capsid protein spans amino acids 203-736 of SEQ ID NO:71.

MAADGYLPDWLEDNLSEGIREWWDLKPGAPKPKANQQKQDDGRGLVLPGYK

YLGPFNGLDKGEPANAADAAALEHDKAYDQQLKAGDNPYLRYNHADAEFQE

RLQEDTSFGGNLGRAIFQAKKRVLEPLGLVEEGAKTAPGKKGPVEQSPQEP

DSSSGIGKTGQQPAKKRLNFGQTGDSESVPDPQPLGEPPAAPSGLGPNTMA

SGGGAPMADNNEGADGVGNSSGNWHCDSTWLGDRVITTSTRTWALPTYNNH

LYKQISNGTSGGSTNDNTYFGYSTPWGYFDFNRFHCHFSPRDWQRLINNNW

GFRPKRLNFKLFNIQVKEVTTNEGTKTIANNLTSTVQVFTDSEYQLPYVLG

SAHQGCLPPFPADVFMVPQYGYLTLNNGSQALGRSSFYCLEYFPSQMLRTG

NNFQFSYTFEDVPFHSSYAHSQSLDRLMNPLIDQYLYYLVRTQTTGTGGTQ

TLAFSQAGPSSMANQARNWVPGPCYRQQRVSTTTNQNNNSNFAWTGAAKFK

LNGRDSLMNPGVAMASHKDDDDRFFPSSGVLIFGKQGTGNDGVDYSQVLIT

DEEEIKATNPVATEEYGAVAINNQAANTQAQTGLVHNQGVIPGMVWQNRDV

YLQGPIWAKIPHTDGNFHPSPLMGGFGLKHPPPQILIKNTPVPADPPLTFN

QAKLNSFITQYSTGQVSVEIEWELQKENSKRWNPEIQYTSNYYKSTNVDFA

VNTEGVYSEPRPIGTRYLTRNL

The VP1 sequence of a novel AAV capsid isolated from rhesus macaque (denoted as Brh.27) is set out as SEQ ID NO:72 and (amino acids 1-736) and the locations of the associated variable regions and GBS and GH loop regions are defined in Table 2 below. The VP2 capsid protein spans amino acids 138-736 of SEQ ID NO:72 and the VP3 capsid protein spans amino acids 203-736 of SEQ ID NO:72.

MAADGYLPDWLEDNLSEGIREWWDLKPGAPKPKANQQKQDDGRGLVLPGYK

YLGPFNGLDKGEPVNAADAAALEHDKAYDQQLKAGDNPYLRYNHADAEFQE

RLQEDTSFGGNLGRAIFQAKKRVLEPLGLVEEGAKTAPGKKRPVEQSPQEP

DSSSGIGKTGQQPAKKRLNFGQTGDSESVPDPQPLGEPPAAPSGLGPNTMA

SGGGAPMADNNEGADGVGNPSGNWHCDSTRLGDRVITTSTRTWALPTYNNH

LYKQISNGTSGGSTNDNTYFGYSTPWGYFDFNRFHCHFSPRDWQRLINNNW

GFRPKRLNFKLFNIQVKEVTTNEGTKTIANNLTSTVQVFTDSEYQLPYVLG

SAHQGCLPPFPADVFMVPQYGYLTLNNGSQALGRSSFYCLEYFPSQMLRTS

NNFQFSYTFEDVPFHSSYAHSQSLDRLMNPLIDQYLYYLVRTQTTGTGGTQ

TLAFSQAGPSSMANQARNWVPGPCYRQQRVSTTTNQNNNSNFAWTGAAKFK

LNGRDSLMNPGVAMASHKDDDDRFFPSSGVLIFGKQGTGNDGVDYSQVLIT

DEEEIKATNPVATEEYGAVAINNQAANTQAQTGLVHNQGVIPGMVWQNRDV

YLQGPIWAKIPHTDGNFHPSPLMGGFGLKLPPPQILIKNTPVPADPPLTFN

QAKLNSFITQYSTGQVSVEIEWELQKENSKRWNPEIQYTSNYYKSTNVDFA

VNTEGVYSEPRPIGTRYLTRNL

The VP1 sequence of a novel AAV capsid isolated from rhesus macaque (denoted as Brh.28) is set out as SEQ ID NO:73 and (amino acids 1-736) and the locations of the associated variable regions and GBS and GH loop regions are defined in Table 2 below. The VP2 capsid protein spans amino acids 138-736 of SEQ ID NO:73 and the VP3 capsid protein spans amino acids 203-736 of SEQ ID NO:73.

MAADGYLPDWLEDNLSEGIREWWDLKPGAPKPKANQQKQDDGRGLVLPGYK

YLGPFNGLDKGEPVNAADAAALEHDKAYDQQLKAGDNPYLRYNHADAEFQE

RLQEDTSFGGNLGRAIFQAKKRVLEPLGLVEEGAKTAPGKKRPVEQSPQEP

DSPSGIGKTGQQPAKKRLNFGQTGDSESVPDPQPLGEPPAAPSGLGPNTMA

SGGGAPMADNNEGADGVGNSSGNWHCDSTWLGDRVITTSTRTWALPTYNNH

LYKQISNGTSGGSTNDNTYFGYSTPWGYFDFNRFHCHFSPRDWQRLINNNW

GFRPKRLNFKLFNIQVKEVTTNEGTKTIANNLTSTVQVFTDSEYQLPYVLG

SAHQGCLPPFPADVFMVPQYGYLTLNNGSQALGRSSFYCLEYFPSQMLRTG

NNFQFSYTFEDVPFHSSYAHSQSLDRLMNPLIDQYLYYLVRTQTTGTGGTQ

TLAFSQAGPSSMANQARNWVPGPCYRQQRVSTTTNQNNNSNFAWTGAAKFK

LNGRDSLMNPGVAMASHKDDDDRFFPSSGVLIFGKQGTGNDGVDYSQVLIT

DEEEIKATNPVATEEYGAVAINNQAANTQAQTGLVHNQGVIPGMVWQNRDV

YLQGPIWAKIPHTDGNFHPSPLMGGFGLKHPPPQILIKNTPVPADPPLTFN

QAKLNSFITQYSTGQVSVEIEWELQKENSKRWNPEIQYTSNYYKSTNVDFA

VNTEGVYSEPRPIGTRYLTRNL

The VP1 sequence of a novel AAV capsid isolated from rhesus macaque (denoted as Brh.29) is set out as SEQ ID NO:74 and (amino acids 1-736) and the locations of the associated variable regions and GBS and GH loop regions are defined in Table 2 below. The VP2 capsid protein spans amino acids 138-736 of SEQ ID NO:74 and the VP3 capsid protein spans amino acids 203-736 of SEQ ID NO:74.

MAADGYLPDWLEDNLSEGIREWWDLKPGAPKPKANQQKQDDGRGLVLPGYK

YLGPFNGLDKGEPVNAADAAALEHDKAYDQQLKAGDNPYLRYNHADAEFQE

RLQEDTSFGGNLGRAIFQAKRRVLEPLGLVEEGAKTAPGKKRPVEQSPQEP

DSSSGIGKTGQQPAKKRLNFGQTGDSESVPDPQPLGEPPAAPSGLGPNTMA

SGGGAPMADNNEGADGVGNSSGNWHCDSTWLGDRVITTSTRTWALPTYNNH

LYKQISNGTSGGSTNDNTYFGYSTPWGYFDFNRFHCHFSPRDWQRLINNNW

GFRPKRLNFKLFNIQVKEVTTNEGTKTIANNLTSTVQVFTDSEYQLPYVLG

SAHQGCLPPFPADVFMVPQYGYLTLNNGSQALGRSSFYCLEYFPSQMLRTS

NNFQFSYTFEDVPFHSSCAHSQSLDRLMNPLIDQYLYYLVRTQTTGTGGTQ

TLAFSQAGPGSMANQARNWVPGPCYRQQRVSTTTNQNMNSNFAWTGAAKFK

LNGRDSLMNPGVAMASHKDDDDRFFPSSGVLIFGKQGTGNDGVDYSQVLIT

DEEEIKATNPVATEEYGAVAINNQAANTQAQTGLVHNQGVIPGMVWQNRDV

YLQGPIWAKIPHTDGNFHPPPLMGGFGLKHPPPQILIKNTPVPADPPLTFN

QAKLNSFITQYSTGQVSVEIEWELQKENSKRWNPEIQYTSNYYKSTNVDFA

VNTEGVYSEPRPIGTRYLTRNL

The VP1 sequence of a novel AAV capsid isolated from rhesus macaque (denoted as Brh.30) is set out as SEQ ID NO:75 and (amino acids 1-736) and the locations of the associated variable regions and GBS and GH loop regions are defined in Table 2 below. The VP2 capsid protein spans amino acids 138-736 of SEQ ID NO:75 and the VP3 capsid protein spans amino acids 203-736 of SEQ ID NO:75.

MAADGYLPDWLEDNLSEGIREWWDLKPGAPKPKANQQKQDDGRGLVFPGYK

YLGPFNGLDKGEPVNAADAAALEHDKAYDQQLKAGDNPYLRYNHADAEFQE

RLQEDTSFGGNLGRAIFQAKKRVLEPLGLVEEGAKTAPGKKRPVEQSPQEP

DSSSGIGKTGRQPAKKRLNFGQTGDSESVPDPQPLGEPPAAPSGLGPNTMA

SGGGAPMADNNEGADGVGNSSGNWHCDSTWLGDRVITTSTRTWALPTYNNH

LYKQISNGTPGGSTNDNTYFGYSAPWGYFDFNRFHCHFSPRDWQRLINNNW

GFRPKRLNFKLFNIQVKEVTTNEGTKTIANNLTSTVQVFTDSEYQLPYVLG

SAHQGCLPPFPADVFMVPQYGYLTLNNGSQALGRSSFYCLEYFPSQMLRTG

NNFQFSYTFEDVPFHSSYAHSQSLDRLMNPLIDQYLYYLVRTQTTGTGGTQ

TLAFSQAGPSSMANQARNWVPGPCYRQQRVSTTTNQNNNSNFAWTGAAKFK

LNGRDSLMNPGVAMASHKDDDDRFFPSSGVLIFGKQGTGNDGVDYSQVLIT

DEEEIKATNPVATEEYGAVAINNQAANTQAQTGLVHNQGVIPGMVWQNRDV

YQQGPIWAKIPHTDGNFHPSPLMGGFGLKHPPPQILIKNTPVPADPPLTFN

QAKLNSFITQYSTGQVSVEIEWELQKENSKRWNPEIQYTSNYYKSTNVDFA

VNTEGVYSEPRPIGTRYLTRNL

The VP1 sequence of a novel AAV capsid isolated from rhesus macaque (denoted as Brh.31) is set out as SEQ ID NO:76 and (amino acids 1-736) and the locations of the associated variable regions and GBS and GH loop regions are defined in Table 2 below. The VP2 capsid protein spans amino acids 138-736 of SEQ ID NO:76 and the VP3 capsid protein spans amino acids 203-736 of SEQ ID NO:76.

MAADGYLPDWLEDNLSEGIREWWDLKPGAPKPKANQQKQDDGRGLVLPGYK

YLGPFNGLDKGEPVNAADAAALEHDKAYDQQLKAGDNPYLRYNHADAEFQE

RLQEDTSFGGNLGRAIFQAKKRVLEPLGLVEEGAKTAPGKKRPVEQSPQEP

DSSSGIGKTGQQPAKKRLNSGQTGDSESVPDPQPLGEPPAAPSGLGPNTMA

SGGGAPMADNNEGADGVGNSSGNWHCDSTWLGDRVITTSTRTWALPTYNNH

LYKQISNGTSGGSTNDNTYFGYSTPWGYFDFNRFHCHFSPRDWQRLINNNW

GFRPKRLNFKLFNIQVKEVTTNEGTKTIANNLTSTVQVFTDSEYQLPYVLG

SAYQGCLPPFPADVFMVPQYGYLTLNNGSQALGRSSFYCLEYFPSQMLRTG

NNFQSSYTFEDVPFHSSYAHSQSLDRLMNPLIDQYLYYLVRTQTTGTGGTQ

-continued

TLAFSQAGPSSMANQARNWVPGPCYRQQRVSTTTNQNNNSNFAWTGAAKFK

LNGRDSLMNPGVAMASHKDDDDRFFPSSGVLIFGKQGTGNDGVDYSQVLIT

DEEEIKATNPVATEEYGAVAINNQAANTQAQTGLVHNQGVIPGMVWQNRDV

YLQGPIWAKIPHTDGNFHPSPLMGGFGLKHPPPQILIKNTPVPADPPLTFN

QAKLNSFITQYSTGQVSVEIEWELQKENSKRWNPEIQYTSNYYKSTNVDFA

VNTEGVYSEPRPIGTRYLTRNL

The VP1 sequence of a novel AAV capsid isolated from rhesus macaque (denoted as Brh.32) is set out as SEQ ID NO:77 and (amino acids 1-736) and the locations of the associated variable regions and GBS and GH loop regions are defined in Table 2 below. The VP2 capsid protein spans amino acids 138-736 of SEQ ID NO:77 and the VP3 capsid protein spans amino acids 203-736 of SEQ ID NO:77.

MAADGYLPDWLEDNLSEGIREWWDLKPGASKPKANQQKQDDGRGLVLPGYK

YLGPFNGLDKGEPVNAADAAALEHDKAYDQQLKAGDNPYLRYNHADAEFQE

RLQEDTSFGGNLGRAVFQAKKRVLEPLGLVEEGAKTVPGKKRPVEQSPQEP

DSSSGIGKTGQQPAKKRLNFGQTGDSESVPDPQPLGEPPAAPSGLGPNTMA

SGGGAPMADNNEGADGVGNSSGNWHCDSTWLGDRVITTSTRTWALPTYNNH

LYKQISNGTSGGSTNDNTYFGYSTPWGYFDFNRFHCHFSPRDWQRLINNNW

GFRPKRLNFKLFNIQVKEVTTNEGTKTIANNLTSTVQVFTDSEYQLPYVLG

SAYQGCLPPFPADVFMVPQYGYLTLNNGSQALGRSSFYCLEYFPSQMLRTG

NNFQFSYTFEDVPFHSSYAHSQSLDRLMNPLIDQYLYYLVRTQTTGTGGTQ

TLAFSQAGPSSMANQARNWVPGPCYRQQRVSTTTNQNNNSNFAWTGAAKFK

LNGRDSLMNPGVAMASHKDDDDRFFPSSGVLIFGKQGTGNDGVDYSQVLIT

DEEEIKATNPVATEEYGAVAINNQAANTQAQTGLVHNQGVIPGMVWQNRDV

YLQGPIWAKIPHTDGNFHPSPLMGGFGLKHPPPQILIKNTPVPADPPLTFN

QAKLNSFITQYSTGQVSVEIEWELQKENSKRWNPEIQYTSNYYKSTNVDFA

VNTEGVYSEPRPIGTRYLTRNL

The VP1 sequence of a novel AAV capsid isolated from rhesus macaque (denoted as Brh.33) is set out as SEQ ID NO:78 and (amino acids 1-736) and the locations of the associated variable regions and GBS and GH loop regions are defined in Table 2 below. The VP2 capsid protein spans amino acids 138-736 of SEQ ID NO:78 and the VP3 capsid protein spans amino acids 203-736 of SEQ ID NO:78.

MAADGYLPDWLEDNLSEGIREWWDLKPGASKPKANQQKQDDGRGLVLPGYK

YLGPFNGLDKGEPVNAADAAALEHDKAYDQQLKAGDNPYLRYNHADAEFQE

RLQEDTSFGGNLGRAVFQAKKRVLEPLGLVEEGAKTVPGKKRPVEQSPQEP

DSSSGIGKTGQQPAKKRLNFGQTGDSESVPDPQPLGEPPAAPSGLGPNTMA

SGGGAPMADNNEGADGVGNSSGNWHCDSTWLGDRVITTSTRTWALPTYNNH

LYKQISNGTSGGSTNDNTYFGYSTPWGYFDFNRFHCHFSPRDWQRLINNNW

GFRPKRLNFKLFNIQVKEVTTNEGTKTIANNLTSTVQVFTDSEYQLPYVLG

SAYQGCLPPFPADVFMVPQYGYLTLNNGSQALGRSSFYCLEYFPSQMLRTG

NNFQFSYTFEDVPFHSSYAHSQSLDRLMNPLIDQYLYYLVRTQTTGTGGTQ

TLAFSQAGPSSMANQARNWVPGPCYRQQRVSTTTNQNNNSNFAWTGAAKFK

LNGRDSLMNPGVAMASHKDDDDRFFPSSGVLIFGKQGTGNDGVDYSQVLIT

DEEEIKATNPVATEEYGAVAINNQAANTQAQTGLVHNQGVIPGMVWQNRDV

YLQGPIWAKIPHTDGNFHPSPLMGGFGLKHPPPQILIKNTPVPADPPLTFN

QAKLNSFITQYSTGQVSVEIEWELQKENSKRWNPEIQYTSNYYKSTNVDFA

VNTEGVYSEPRPIGTRYLTRNL

The VP1 sequence of a novel AAV capsid isolated from formosan macaque (denoted as Bfm.17) is set out as SEQ ID NO:79 and (amino acids 1-737) and the locations of the associated variable regions and GBS and GH loop regions are defined in Table 2 below. The VP2 capsid protein spans amino acids 138-737 of SEQ ID NO:79 and the VP3 capsid protein spans amino acids 203-737 of SEQ ID NO:79.

MAADGYLPDWLEDNLSEGIREWWALKPGAPKPKANQQKQDDGRGLVLPGYK

YLGPFNGLDKGEPVNAADAAALEHDKAYDQQLQAGDNPYLRYNHADAEFQE

RLQEDTSFGGNLGRAVFQAKKRVLEPLGLVEEGAKTAPGKKRPVEQSPQEP

DSSSGIGKKGQQPAKKRLNFGQTGDSESVPDPQPLGEPPAAPSSLGLNTMA

AGGGAPMADNNEGADGVGSSSGNWHCDSTRLGDRVITTSTRTWALPTYNNH

LYKQISNGTSGGSTNDNTYFGYSTPWGYFDFNRFHCHFSPRDWQRLINNNW

GFRPKKLSFKLFNIQVKEVTQNEGTKTIANNLTSTIQVFTDSEYQLSYVLG

SAHQGCLPPFPADVFMIPQYGYLTLNNGSQAVGRSSFYCLEYFPSQMLRTG

NNFSFSYTFEDVPFHSSYAHSQSLDRLMNPLIDQYLYYLSRTQSTGGTAGT

QQLLFSQAGPNNMSAQAKNWLPGPMYRQQRVSTTLSQNNNSNFAWTGGTKY

HLNGRDSLVNPGVAMATNKDDEDRFFPSSGVLMFGKQGAGKDNVDYSSVML

TSEEEIKTTNPVATEQYGVVADNLQQQNTAPIVGAVNSQEALPGMVWQNRD

VYLQGPIWAKIPHTDGNFHPSPLMGGFGLKHPPPQILIKNTPVPADPPTAF

NQAKLNSFITQYSTGQVSVEIEWELQKENSKRWNPEIQYTSNYYKSTNVDF

AVDTEGVYSEHRPIGTRYLTRNL

The VP1 sequence of a novel AAV capsid isolated from formosan macaque (denoted as Bfm.18) is set out as SEQ ID NO:80 and (amino acids 1-737) and the locations of the associated variable regions and GBS and GH loop regions are defined in Table 2 below. The VP2 capsid protein spans amino acids 138-737 of SEQ ID NO:80 and the VP3 capsid protein spans amino acids 203-737 of SEQ ID NO:80.

MAADGYLPDWLEDNLSEGIREWWALKPGAPKPKANQQKQDDGRGLVLPGYK

YLGPFNGLDKGEPVNAADAAALEHDKAYDQQLQAGDNPYLRYNHADAEFQE

RLQEDTSFGGNLGRAVFQAKKRVLEPLGLVEEGAKTAPGKKRPVEQSPQEP

DSSSGIGKKGQQPAKKRLNFGQTGDSESVPDPQPLGEPPAAPSSLGLNTMA

AGGGAPMADNNEGADGVGSSSGNWHCDSTWLGDRVITTSTRTWALPTYNNH

LYKQISNGTSGGSTNDNTYFGYSTPWGYFDFNRFHCHFSPRDWQRLINNNW

GFRPKKLSFKLFNIQVKEVTQNEGTKTIANNLTSTIQVFTDSEYQLPYVPG

SAHQGCLPPFPADVFMIPQYGYLTLNNGSQAVGRSSFYCLEYFPSQMLRTG

-continued
NNFSFSYTFEDVPFHSSYAHSQSLDRLMNPLIDQYLYYLSRTQSTGGTAGT

QQLLFSQAGPNNMSAQAKNWLPGPMYRQQRVSTTLSQNNNSNFAWTGGTKY

HLNGRDSLVNPGVAMATNKDDEDRFFPSSGVLMFGKQGAGKDNVDYSSVML

TSEEEIKTTNPVATEQYGVVADNLQQQNTAPIVGAVNSQGALPGMVWQNRD

VYPQGPIWAKIPHTDGNFHPSPLMGGFGLKHPPPQILIKNTPVPADPPTAF

NQAKLNSFITQYSTGQVSVEIEWELQKENSKRWNPEIQYTSNYYKSTNVDF

AVNTEGVYSEPRPIGTRYLTRNL

The VP1 sequence of a novel AAV capsid isolated from formosan macaque (denoted as Bfm.20) is set out as SEQ ID NO:81 and (amino acids 1-737) and the locations of the associated variable regions and GBS and GH loop regions are defined in Table 2 below. The VP2 capsid protein spans amino acids 138-736 of SEQ ID NO:81 and the VP3 capsid protein spans amino acids 203-736 of SEQ ID NO:81.

MAADGYLPDWLEDNLSEGIREWWALKPGAPKPKANQQKQDDGRGLVLPGYK

YLGPFNGLDKGEPVNAADAAALEHDKAYDQQLQAGDNPYLRYNHADAEFQE

RLQEDTSFGGNLGRAVFQAKKRVLEPPGLVEEGAKTAPGKKRPVEQSPQEP

DSSSGIGKKGQQPAKKRLNFGQTGDSESVPDPQPLGEPPAAPSSLGLNTMA

AGGGAPMADNNEGADGVGSSSGNWHCDSTWLGDRVITTSTRTWALPTYNNH

LYKQISNGTSGGSTNDNTYFGYSTPWGYFDFNRFHCHFSPRDWQRLINNNW

GFRPKKLSFKLFNIQVKEVTQNEGTKTIANNLTSTIQVFTDSEYQLPYVLG

SAHQGCLPPFPADVFMIPQYGYLTLNNGSQAVGRSFFYCLEYFPSQMLRTG

NNFSFSYTFEDVPFHSSYAHSQSLDRLMNPLIDQYLYYLSRTQSTGGTAGT

QQLLFSQAGPNNMSAQAKNWLPGPMYRQQRVSTTLSQNNNSNFAWTGGTKY

HLNGRDSLVNPGVAMATNKDDEDRFFPSSGVLMFGKQGAGKDNVDYSSVML

TSEEEIKTTNPVATEQYGVVADNLQQQNTAPIVGAVNSQGALPGMVWQNRD

VYPQGPIWAKIPHTDGNFHPSPLMGGFGLKHPPPQILIKNTPVPADPPTAF

NQAKLNSFITQYSTGQVSVEIERELQKENSKRWNPEIQYTSNYYKSTNVDF

AVNTEGVYSEPRPIGTRYLTRNL

The VP1 sequence of a novel AAV capsid isolated from formosan macaque (denoted as Bfm.21) is set out as SEQ ID NO:82 and (amino acids 1-737) and the locations of the associated variable regions and GBS and GH loop regions are defined in Table 2 below. The VP2 capsid protein spans amino acids 138-736 of SEQ ID NO:82 and the VP3 capsid protein spans amino acids 203-736 of SEQ ID NO:82.

MAADGYLPDWLEDNLSEGIREWWALKPGAPKPKANQQKQDDGRGLVLPGYK

GYLGPFNGLDKGEPVNAADAAALEHDKAYDQQLQADNPYLRYNHADAEFQE

RLQEDTSFGGNLGRAVFQAKKRVLEPLGLVEEGAKTAPGKERPVEQSPQEP

DSSSGIGKKGQQPAKKRLNFGQTGDSESVPDPQPLGEPPAAPSSLGLNTMA

AGGGAPMADNNEGADGVGSSSGNWHCDSTWLGDRVITTSTRTWALPTYNNH

SLYKQINGTSGGSTNDNTYFGYSTPWGYFDFNRFHCHFSPRDWQRLINNNW

GFRPKKLSFKLFNIQVKEVTQNEGTKTIANNLTSTIQVFTDSEYQLPYVLG

-continued
SAHQGCLPPFPADVFMIPQYGYLTLNNGSQAVGRSSFYCLEYFPSQMLRTG

NNFSFSYTFEDVPFHSSYAHSQSLDRLMNPLIDQYLYYLSRTQSTGGTAGT

QQLLFSQAGPNNMSAQAKNWLPGPMYRQQRVSTTLSQNNNSNFAWTGGTKY

HLNGRDSLVNPGVAMATNKDDEDRFFPSSAVLMFGKQGAGKDNVDYSSVML

TSEEEIKTTNPVTTEQYGVVADNLQQQNTAPIVGAVNSQGALPGMVWQNRD

VYLQGPIWAKIPHTDGNFHPSPLMGGFGLKHPPPQILIKNTPVPADPPTAF

NQAKLNSFITQYSTGQVSVEIEWELQKENSKRWNPEIQYTSNYYKSTNVDF

AVNTESVYSEPRPIGTRYLTRNL

The VP1 sequence of a novel AAV capsid isolated from formosan macaque (denoted as Bfm.24) is set out as SEQ ID NO:83 and (amino acids 1-737) and the locations of the associated variable regions and GBS and GH loop regions are defined in Table 2 below. The VP2 capsid protein spans amino acids 138-736 of SEQ ID NO:83 and the VP3 capsid protein spans amino acids 203-736 of SEQ ID NO:83.

MAADGYLPDWLEDNLSEGIREWWALKPGAPKPKANQQKQDDGRGLVLPGY

KYLGPFNGPDKGEPVNAADAAALEHDKAYDQQLQAGDNPYLRYNHADAEF

QERLQEDTSFGGNLGRAVFQAKKRVLEPLGLVEEGAKTAPGKKRPVEQSP

QEPDSSSGIGKKGQQPAKKRLNFGQTGDSESVPDPQPLGEPPAAPSSLGL

NTMAAGGGAPMADNNEGADGVGSSSGNWHCDSTWLGDRVITTSTRTWALP

TYNNHLYKQISNGTSGGSTNDNTYFGYSTPWGYFDFNRSHCHFSPRDWQR

LINNNWGFRPKKLSFKLFNIQVKEVTQNEGTKTIANNLTSTIQVFTDSEY

QLPYVLGSAHQGCLPPFPADVFMIPQYGYLTLNNGSQAVGRSSFYCLEYF

PSQMLRTGNNFSFSYTFEDVPFHSSYAHSQSLDRLMNPLIDQYLYYLSRT

QSTGGTAGTQQLLFSQAGPNNMSAQAKNWLPGPMYRQQRVSTTLSQNNNS

NFAWTGGTKYHLNGRDSLVNPGVAMATNKDDEDRFFPSSGVLMFGKQGAG

KDNVDYSSVMLTSEEEIRTTNPVATEQYGVVADNLQQQNTAPIVGAVNSQ

GALPGMVWQNRDVYLQGPIWAKIPHTDGNFHPSPLMGGFGLKHPPPQILI

KNTPVPADPPTAFNQAKLNSFITQYSTGQVSVEIEWELQKENSKRWNPEI

QYTSNYYKSTNVDFAVNTEGVYSEPRPIGTRYLTRNL

The VP1 sequence of a novel AAV capsid isolated from formosan macaque (denoted as Bfm.25) is set out as SEQ ID NO:84 and (amino acids 1-737) and the locations of the associated variable regions and GBS and GH loop regions are defined in Table 2 below. The VP2 capsid protein spans amino acids 138-736 of SEQ ID NO:84 and the VP3 capsid protein spans amino acids 203-736 of SEQ ID NO:84.

MAADGYLPDWLEDNLSEGIREWWALKPGAPKPKANQQKQDDGRGLVLPGY

KYLGPFNGLDKGEPVNAADAAALEHDKAYDQQLQAGDNPYLRYNHADAEF

QERLQEDTSFGGNLGRAVFQAKKRVLEPLGLVEEGAKTAPGKKRPVEQSP

QEPDSSSGIGKKGQQPAKKRLNFGQTGDSESVPDPQPLGEPPAAPSSLGL

NTMAAGGGAPMADNNEGADGVGSSSGNWHCDSTWLGDRVITTSTRTWALP

TYNNHLYKQISNGTSGGSTNDNTYFGYSTPWGYFDFNRFHCHFSPRDWQR

LINNNWGFRPKKLSFKLFNIQVKEVTQNEGTKTIANNLTSTIQVFTDSEY

-continued

QLPYVLGSAHQGCLPPFPADVFMIPQYGYLTLNNGSQAVGRSSFYCLEYF

PSQMLRTGNNFSFSYTFEDVPFHSSYAHSQSLDRLMNPLIDQYLYYLSRT

QSTGGTAGTQQLLFSQAGPNNMSAQAKNWLPGPMYRQQRVSTTLSQNNNS

NFAWTGGTKYHLNGRDSLVNPGVAMATNKDDEDRLFPSSGVLMFGKQGAG

KDNVDYSSVMLTSEEEVKTTNPVATEQYGVVADNLQQQNTAPIVGAVNSQ

GALPGMVWQNRDVYLQGPIWAKIPHTDGNFHPSPLMGGFGLKHPPPQILI

KNTPVPADPPTAFNQAKLNSFITQYSTGQVSVEIEWELQKENSKRWNPEI

QYTSNYYKSTNVDFAVNTEGVYSEPRPIGTRYLTRNL

The VP1 sequence of a novel AAV capsid isolated from formosan macaque (denoted as Bfm.27) is set out as SEQ ID NO:85 and (amino acids 1-737) and the locations of the associated variable regions and GBS and GH loop regions are defined in Table 2 below. The VP2 capsid protein spans amino acids 138-736 of SEQ ID NO:85 and the VP3 capsid protein spans amino acids 203-736 of SEQ ID NO:85.

MAADGYLPDWLEDNLSEGIREWWALKPGAPKPKANQQKQDDGRGLVLPGY

KYLGPFNGLDKGEPVNAADAAALEHDKAYDQQLQAGDNPYLRYNHADAEF

QERLQEDTSFGGNLGRAVFQAKRRVLEPLGLVEEGAKTAPGKKRPVEQSP

QEPDSSSGIGKKGQQPAKKRLNFGQTGDSESVPDPQPLGEPPAAPSSLGL

NTMAAGGGAPMADNNEGADGVGSSSGNWHCDSTWLGDRVITTSTRTWALP

TYNNHLYKQISNGTSGGSTNDNTYFGYSTPWGYFDFNRFHCHFSPRDWQR

LINNNWGFRPKKLSFKLFNIQVKEVTQNEGTKTIANNLTSTIQVFTDSEY

QLPYVLGSARQGCLPPFPADVFMIPQYGYLTLNNGSQAVGRSSFYCLEYF

PSQMLRTGNNFSFSYTFEDVPFHSSYAHSQSLDRLMNPLIDQYLYYLSRT

QSTGGTAGTQQLLFSQAGPNNMSAQAKNWLPGPMYRQQRVSTTLSQNNNS

NFAWTGGTKYHLNGRDSLVNPGVAMATNKDDEDRFFPSSGVLMFGKQGAG

KDNVDYSSVMLTSEEEIKTTNPVATEQYGVVADNLQQQNTAPIVGAVNSQ

GALPGMVWQNRDVYLQGPIWAKIPHTDGNFHPSPLMGGFGLKHPPPQILI

KNTPVPADPPTAFNQAKLNSFITQYSTGQVSVEIEWELQKENSKRWNPEI

QYTSNYYKSTNVDFAVDTEGVYSEPRPIGTRYLTRNL

The VP1 sequence of a novel AAV capsid isolated from formosan macaque (denoted as Bfm.32) is set out as SEQ ID NO:86 and (amino acids 1-737) and the locations of the associated variable regions and GBS and GH loop regions are defined in Table 2 below. The VP2 capsid protein spans amino acids 138-736 of SEQ ID NO:86 and the VP3 capsid protein spans amino acids 203-736 of SEQ ID NO:86.

MAADGYLPDWLEDNLSEGIREWWALKPGAPKPKANQQKQDDGRGLVLPGY

KYLGPFNGLDKGEPVNAADAAALEHDKAYDQQLQAGDNPYLRYNHADAEF

QERLQEDTSFGGNLGRAVFQAKKRVLEPLGLVEEGAKTAPGKKRPVEQSP

QEPDSSSGIGKKGQQPAKKRLNFGQTGDSESVPDPQPLGEPPAAPSSLGL

NTMAAGGGAPMADNNEGADGVGSSSGNWHCDSTWLGDRVITTSTRTWALP

TYNNHLYKQISNGTSGGSTNDNTYFGYSTPWGYFDFNRFHCHFSPRDWQR

-continued

LINNNWGFRPKKLSFKLFDIQVKEVTQNEGTKTIANNLTSTIQVFTDSEY

QLPYVLGSAHQGCLPPFPADVFMIPQYGYLTLNNGSQAVGRSSFYCLEYF

PSQMLRTGNNFSFSYTFEDVPFHSSYAHSQSLDRLMNPLIDQYLYYLSRT

QSTGGTAGTQQLLFSQAGPNNMSAQAKNWLPGPMYRQQRVSTTLSQNNNS

NFAWTGGTKYHLNGRDSLVNPGVAMATNKDDEDRFFPSSGVLMFGKQGAG

KDNVDYSSVMLTSEEEIKTTNPVATEQYGVVADNLQQQNTAPIVGAVNSQ

GALPGMVWQNRDVYLQGPIWAKIPHTDGNFHPSPLMGGFGLKHPPPQILI

KNTPVPADPPTAFNQAKLNSFITQYSTGQVSVEIEWELQKENSKRWNPEI

QYTSNYYKSTNVDFAVNTEGVYSEPRPIGTRYLTRNL

The VP1 sequence of a novel AAV capsid isolated from formosan macaque (denoted as Bfm.33) is set out as SEQ ID NO:87 and (amino acids 1-737) and the locations of the associated variable regions and GBS and GH loop regions are defined in Table 2 below. The VP2 capsid protein spans amino acids 138-736 of SEQ ID NO:87 and the VP3 capsid protein spans amino acids 203-736 of SEQ ID NO:87.

MAADGYLPDWLEDNLSEGIREWWALKPGAPKPKANQQKQDDGRGLVLPGY

KYLGPFNGLDKGEPVNAADAAALEHDKAYDQQLQAGDNPYLRYNHADAEF

QERLQEDTSFGGNLGRAVFQAKKRVLEPLGLVEEGAKTAPGKKRPVEQSP

QEPDSSSGIGKKGQQPAKKRLNFGQTGDSESVPDPQPLGEPPAAPSSLGL

NTMAAGGGAPMADNNEGADGVGSSSGNWHCDSTWLGDRVITTSTRTWALP

TYNNHLYKQISNGTSGGSTNDNTYFGYSTPWGYFDFNRFHCHFSPRDWQR

LINNNWGFRPKKLSFKLFNIQVKEVTQNEGTKTIANNLTSTIQVFTDSEY

QLPYVLGSAHQGCLPPFPADVFMIPQYGYLTLNNGSQAVGRSSFYCLEYF

PSQMLRTGNNFSFSYTFEDVPFHSSYAHSQSLDRLMNPLIDQYLYYLSRT

QSTGGTAGTQQLLFSQAGPNNMSAQAKNWLPGPMYRQQRVSTTLSQNNNS

NFAWTGGTKYHLNGRDSLVNPGVAMATNKDDEDRFFPSSAVLMFGKQGAG

KDNVDYSSVMLTSEEEIKTTNPVATEQYGVVADNLQQQNTAPIVGAVNSQ

GALPGMVWQNRDVYLQGPIWAKIPHTDGNFHPSPLMGGFGLKHPPPQILI

KNTPVPADPPTAFNQAKLNSFITQYSTGQVSVEIEWELQKENSKRWNPEI

QYTSNYYKSTNVDFAVNTESVYSEPRPIGTRYLTRNL

The VP1 sequence of a novel AAV capsid isolated from formosan macaque (denoted as Bfm.34) is set out as SEQ ID NO:88 and (amino acids 1-737) and the locations of the associated variable regions and GBS and GH loop regions are defined in Table 2 below. The VP2 capsid protein spans amino acids 138-736 of SEQ ID NO:88 and the VP3 capsid protein spans amino acids 203-736 of SEQ ID NO:88.

MAADGYLPDWLEDNLSEGIREWWALKPGAPKPKANQQKQDDGRGLVLPGY

KYLGPFNGLDKGEPVNAADAAALEHDKAYDQQLQAGDNPYLRYNHADAEF

QERLQEDTSFGGNLGRAVFQAKKRVLEPLGLVEEGAKTAPGKKRPVEQSP

QEPDSSSGIGKKGQQPAKKRLNFGQTGDSESVPDPQPLGEPPAAPSSLGL

NTMAAGGGAPMADNNEGADGVGSSSGNWHCDSTWLGDRVITTSTRTWALP

TYNNHLYKQISNGTSGGSTNDNTYFGYSTPWGYFDFNRFHCHFSPRDWQR

-continued

LINNNWGFRPKKLSFKLFNIQVKEVTQNEGTKTIANNLTSTIQVFTDSEY

QLPYVLGSAHQGCLPPFPADVFMIPQYGYLTLNNGSQAVGRSSFYCLEYF

PSQMLRTGNNFSFSYTFEDVPFHSSYAHSQSLDRLMNPLIDQYLYYLSRT

QSTGGTAGTQQLLFSQAGPNNMSAQAKNWLPGPMYRQQRVSTTLSQNNNS

NFAWTGGTKYHLNGRDSLVYPGVAMATNKDDEDRFFPSSGVLMFGKQGAG

KDNVDYSSVMLTSEEEIKTTNPVATEQYGVVADNLQQQNTAPIVGAVNSQ

GALPGMVWQNRDVYLQGPIWAKIPHTDGNFHPSPLMGGFGLKHPPPQILI

KNTPVPADPPTAFNQAKLNSFITQYSTGQVSVEIEWELQKENSKRWNPEI

QYTSNYYKSTNVDFAVNTEGVYSEPRPIGTRYLTRNL

The VP1 sequence of a novel AAV capsid isolated from formosan macaque (denoted as Bfm.35) is set out as SEQ ID NO:89 and (amino acids 1-737) and the locations of the associated variable regions and GBS and GH loop regions are defined in Table 2 below. The VP2 capsid protein spans amino acids 138-736 of SEQ ID NO:89 and the VP3 capsid protein spans amino acids 203-736 of SEQ ID NO:89.

MAADGYLPDWLEDNLSEGIREWWALKPGAPKPKANQQKQDDGRGLVLPGY

KYLGPFNGLDKGGPVNAADAAALEHDKAYDQQLQAGDNPYLRYNHADAEF

RERLQEDTSFGGNLGRAVFQAKKRVLEPLGLVEEGAKTAPGKKRPVEQSP

QEPDSSSGIGKKGQQPAKKRLNFGQTGDSESVPDPQPLGEPPAAPSSLGL

NTMAAGGGAPMADNNEGADGVGSSSGNWHCDSTWLGDRVITTSTRTWALP

TYNNHLYKQISNGTSGGSTNDSTYFGYSTPWGYFDFNRSHCHFSPRDWQR

LINNNWGFRPKKLSFKLFNIQVKEVTQNEGTKTIANNLTSTIQVFTDSEY

QLPYVLGSAHQGCLPPFPADVFMIPQYGYLTLNNGGQAVGRSSFYCLEYF

PSQMLRTGNNFSFSYIFEDVPFHSSYAHSQSLDRLMNPLIDQYLYYLSRT

QSTGGTAGTQQLLFSQAGPNNMSAQAKNWLPGPMYRQQRVSTTLSQNNNS

NFAWTGGTKYHLNGRDSLVNPGVAMATNKDDEDRFFPSSGVLMFGKQGAG

KDNVDYSSVMLTSEEEIKTTNPVATEQYGVVADNLQQQNTAPIVGAVNSQ

GALPGMVWQNRDVYLQGPIWAKIPHTDGNFHPSPLMGGFGLKHPPPQILI

KNTPVPADPPTAFNQAKLNSFITQYSTGQVSVEIEWELLKESSKRWNPEI

QYTSNYYKSTNVDFAVNTEGVYSEPRPIGTRYLTRNL

In Table 2 immediately below, "VR" refers to the variable region and the numbers refer to the amino acid residues each variable region or the GBS and GH loop regions span in the amino acid sequence.

TABLE 2

| AAV | VRI | VRII | VRIII | VRIV | GBS | VRV | VRVI | VRVII | VRVIII | VRIX | GHloop |
|---|---|---|---|---|---|---|---|---|---|---|---|
| AAV2 | 262- | 325- | 380- | 450- | 464- | 487- | 526- | 544- | 580- | 703- | 446- |
| (SEQ ID NO: 3) | 268 | 330 | 384 | 459 | 475 | 504 | 538 | 557 | 592 | 711 | 600 |
| AAV4 | 256- | 316- | 372- | 444- | 459- | 481- | 526- | 542- | 579- | 702- | 440- |
| (SEQ ID NO: 4) | 260 | 321 | 378 | 454 | 470 | 504 | 536 | 556 | 591 | 710 | 599 |
| AAV5 | 252- | 316- | 372- | 443- | 452- | 474- | 513- | 531- | 570- | 692- | 439- |
| (SEQ ID NO: 5) | 258 | 321 | 377 | 446 | 462 | 491 | 525 | 547 | 582 | 700 | 590 |
| AAV6 | 262- | 326- | 381- | 451- | 465- | 488- | 527- | 545- | 581- | 704- | 447- |
| (SEQ ID NO: 6) | 269 | 331 | 385 | 460 | 476 | 505 | 539 | 558 | 593 | 712 | 601 |
| AAV6.2 | 262- | 326- | 381- | 451- | 465- | 488- | 527- | 545- | 581- | 704- | 447- |
| (SEQ ID NO: 7) | 269 | 331 | 385 | 460 | 476 | 505 | 539 | 558 | 593 | 712 | 601 |
| AAV7 | 263- | 327- | 382- | 452- | 467- | 490- | 529- | 547- | 582- | 705- | 448- |
| (SEQ ID NO: 8) | 270 | 332 | 386 | 462 | 478 | 507 | 541 | 559 | 594 | 713 | 602 |
| AAV8 | 263- | 328- | 383- | 453- | 467- | 490- | 529- | 548- | 583- | 706- | 449- |
| (SEQ ID NO: 9) | 271 | 333 | 387 | 462 | 478 | 507 | 541 | 560 | 595 | 714 | 603 |
| AAV9 | 262- | 327- | 382- | 452- | 465- | 488- | 527- | 545- | 581- | 704- | 448- |
| (SEQ ID NO: 10) | 270 | 332 | 386 | 460 | 476 | 505 | 539 | 558 | 593 | 712 | 602 |
| AAVrh8 | 262- | 327- | 382- | 452- | 465- | 488- | 527- | 545- | 581- | 704- | 448- |
| (SEQ ID NO: 11) | 270 | 332 | 386 | 460 | 476 | 505 | 539 | 558 | 593 | 712 | 602 |
| AAVrh10 | 263- | 328- | 383- | 453- | 467- | 490- | 529- | 548- | 583- | 706- | 449- |
| (SEQ ID NO: 12) | 271 | 333 | 387 | 462 | 478 | 507 | 541 | 560 | 595 | 714 | 603 |
| AAVbo | 258- | 318- | 374- | 446- | 462- | 484- | 528- | 544- | 581- | 704- | 442- |
| (SEQ ID NO: 1) | 262 | 323 | 380 | 456 | 472 | 506 | 538 | 558 | 593 | 712 | 601 |
| AAVBba.21 | 265- | 325- | 381- | 452- | 468- | 490- | 534- | 550- | 587- | 710- | 448- |
| (SEQ ID NO: 15) | 269 | 330 | 386 | 462 | 478 | 512 | 544 | 564 | 599 | 718 | 607 |
| AAVBba.31 | 265- | 325- | 381- | 452- | 468- | 490- | 534- | 550- | 587- | 710- | 448- |
| (SEQ ID NO: 20) | 269 | 330 | 386 | 462 | 478 | 512 | 544 | 564 | 599 | 718 | 607 |
| AAVBba.32 | 265- | 325- | 381- | 452- | 468- | 490- | 534- | 550- | 587- | 710- | 448- |
| (SEQ ID NO: 21) | 269 | 330 | 386 | 462 | 478 | 512 | 544 | 564 | 599 | 718 | 607 |
| AAVBba.33 | 265- | 325- | 381- | 452- | 468- | 490- | 534- | 550- | 587- | 710- | 448- |
| (SEQ ID NO: 22) | 269 | 330 | 386 | 462 | 478 | 512 | 544 | 564 | 599 | 718 | 607 |
| AAVBpo.1 | 243- | 307- | 363- | 434- | 443- | 465- | 505- | 523- | 562- | 684- | 430- |
| (SEQ ID NO: 53) | 249 | 312 | 368 | 437 | 453 | 483 | 517 | 539 | 574 | 692 | 582 |
| AAVBpo.2 | 243- | 307- | 363- | 434- | 443- | 465- | 505- | 523- | 562- | 684- | 430- |
| (SEQ ID NO: 54) | 249 | 312 | 368 | 437 | 453 | 483 | 517 | 539 | 574 | 692 | 582 |
| AAVBpo.3 | 243- | 307- | 363- | 434- | 443- | 465- | 505- | 523- | 562- | 684- | 430- |
| (SEQ ID NO: 55) | 249 | 312 | 368 | 437 | 453 | 483 | 517 | 539 | 574 | 692 | 582 |
| AAVBpo.4 | 243- | 307- | 363- | 434- | 443- | 465- | 505- | 523- | 562- | 684- | 430- |
| (SEQ ID NO: 56) | 249 | 312 | 368 | 437 | 453 | 483 | 517 | 539 | 574 | 692 | 582 |
| AAVBpo.6 | 243- | 307- | 363- | 434- | 443- | 465- | 505- | 523- | 562- | 684- | 430- |
| (SEQ ID NO: 57) | 249 | 312 | 368 | 437 | 453 | 483 | 517 | 539 | 574 | 692 | 582 |
| AAVBpo.8 | 243- | 307- | 363- | 434- | 443- | 465- | 505- | 523- | 562- | 684- | 430- |
| (SEQ ID NO: 58) | 249 | 312 | 368 | 437 | 453 | 483 | 517 | 539 | 574 | 692 | 582 |

TABLE 2-continued

| AAV | VRI | VRII | VRIII | VRIV | GBS | VRV | VRVI | VRVII | VRVIII | VRIX | GHloop |
|---|---|---|---|---|---|---|---|---|---|---|---|
| AAVBpo.13 (SEQ ID NO: 59) | 243-249 | 307-312 | 363-368 | 434-437 | 443-453 | 465-483 | 505-517 | 523-539 | 562-574 | 684-692 | 430-582 |
| AAVBpo.18 (SEQ ID NO: 60) | 243-249 | 307-312 | 363-368 | 434-437 | 443-453 | 465-483 | 505-517 | 523-539 | 562-574 | 684-692 | 430-582 |
| AAVBpo.20 (SEQ ID NO: 61) | 243-249 | 307-312 | 363-368 | 434-437 | 443-453 | 465-483 | 505-517 | 523-539 | 562-574 | 684-692 | 430-582 |
| AAVBpo.23 (SEQ ID NO: 62) | 243-249 | 307-312 | 363-368 | 434-437 | 443-453 | 465-483 | 505-517 | 523-539 | 562-574 | 684-692 | 430-582 |
| AAVBpo.24 (SEQ ID NO: 63) | 243-249 | 307-312 | 363-368 | 434-437 | 443-453 | 465-483 | 505-517 | 523-539 | 562-574 | 684-692 | 430-582 |
| AAVBpo.27 (SEQ ID NO: 64) | 243-249 | 307-312 | 363-368 | 434-437 | 443-453 | 465-483 | 505-517 | 523-539 | 562-574 | 684-692 | 430-582 |
| AAVBpo.28 (SEQ ID NO: 65) | 243-249 | 307-312 | 363-368 | 434-437 | 443-453 | 465-483 | 505-517 | 523-539 | 562-574 | 684-692 | 430-582 |
| AAVBpo.29 (SEQ ID NO: 66) | 243-249 | 307-312 | 363-368 | 434-437 | 443-453 | 465-483 | 505-517 | 523-539 | 562-574 | 684-692 | 430-582 |
| AAVBpo.33 (SEQ ID NO: 67) | 243-249 | 307-312 | 363-368 | 434-437 | 443-453 | 465-483 | 505-517 | 523-539 | 562-574 | 684-692 | 430-582 |
| AAVBpo.35 (SEQ ID NO: 68) | 243-249 | 307-312 | 363-368 | 434-437 | 443-453 | 465-483 | 505-517 | 523-539 | 562-574 | 684-692 | 430-582 |
| AAVBpo.36 (SEQ ID NO: 69) | 243-249 | 307-312 | 363-368 | 434-437 | 443-453 | 465-483 | 505-517 | 523-539 | 562-574 | 684-692 | 430-582 |
| AAVBpo.37 (SEQ ID NO: 70) | 243-249 | 307-312 | 363-368 | 434-437 | 443-453 | 465-483 | 505-517 | 523-539 | 562-574 | 684-692 | 430-582 |
| AAVmo (SEQ ID NO: 2) | 249-252 | 310-315 | 366-371 | 437-439 | 443-455 | 467-484 | 507-519 | 525-533 | 556-568 | 679-689 | 433-576 |
| AAVBce.14 (SEQ ID NO: 32) | 262-270 | 327-332 | 382-386 | 452-460 | 465-476 | 488-505 | 527-539 | 545-558 | 581-593 | 704-712 | 448-602 |
| AAVBce.15 (SEQ ID NO: 33) | 262-270 | 327-332 | 382-386 | 452-460 | 465-476 | 488-505 | 527-539 | 545-558 | 581-593 | 704-712 | 448-602 |
| AAVBce.16 (SEQ ID NO: 34) | 262-270 | 327-332 | 382-386 | 452-460 | 465-476 | 488-505 | 527-539 | 545-558 | 581-593 | 704-712 | 448-602 |
| AAVBce.17 (SEQ ID NO: 35) | 262-270 | 327-332 | 382-386 | 452-460 | 465-476 | 488-505 | 527-539 | 545-558 | 581-593 | 704-712 | 448-602 |
| AAVBce.18 (SEQ ID NO: 36) | 262-270 | 327-332 | 382-386 | 452-460 | 465-476 | 488-505 | 527-539 | 545-558 | 581-593 | 704-712 | 448-602 |
| AAVBce.20 (SEQ ID NO: 37) | 262-270 | 327-332 | 382-386 | 452-460 | 465-476 | 488-505 | 527-539 | 545-558 | 581-593 | 704-712 | 448-602 |
| AAVBma.42 (SEQ ID NO: 51) | 262-270 | 327-332 | 382-386 | 452-460 | 465-476 | 488-505 | 527-539 | 545-558 | 581-593 | 704-712 | 448-602 |
| AAVBma.43 (SEQ ID NO: 52) | 262-270 | 327-332 | 382-386 | 452-460 | 465-476 | 488-505 | 527-539 | 545-558 | 581-593 | 704-712 | 448-602 |
| AAVBce.39 (SEQ ID NO: 40) | 262-270 | 327-332 | 382-386 | 452-460 | 465-476 | 488-505 | 527-539 | 545-558 | 581-593 | 704-712 | 448-602 |
| AAVBce.40 (SEQ ID NO: 41) | 262-270 | 327-332 | 382-386 | 452-460 | 465-476 | 488-505 | 527-539 | 545-558 | 581-593 | 704-712 | 448-602 |
| AAVBce.41 (SEQ ID NO: 42) | 262-270 | 327-332 | 382-386 | 452-460 | 465-476 | 488-505 | 527-539 | 545-558 | 581-593 | 704-712 | 448-602 |
| AAVBce.42 (SEQ ID NO: 43) | 262-270 | 327-332 | 382-386 | 452-460 | 465-476 | 488-505 | 527-539 | 545-558 | 581-593 | 704-712 | 448-602 |
| AAVanc110 (SEQ ID NO: 14) | 262-270 | 327-332 | 382-386 | 452-460 | 465-476 | 488-505 | 527-539 | 545-558 | 581-593 | 704-712 | 448-602 |
| AAVanc80 (SEQ ID NO: 13) | 262-269 | 326-331 | 381-385 | 451-460 | 465-476 | 488-505 | 527-539 | 545-558 | 581-593 | 704-712 | 447-601 |
| AAVBce.35 (SEQ ID NO: 38) | 258-265 | 322-327 | 377-381 | 447-455 | 460-471 | 483-500 | 522-534 | 540-552 | 575-587 | 698-706 | 443-595 |
| AAVBce.36 (SEQ ID NO: 39) | 258-265 | 322-327 | 377-381 | 447-455 | 460-471 | 483-500 | 522-534 | 540-552 | 575-587 | 698-706 | 443-595 |
| AAVBce.43 (SEQ ID NO: 44) | 258-265 | 322-327 | 377-381 | 447-455 | 460-471 | 483-500 | 522-534 | 540-552 | 575-587 | 698-706 | 443-595 |
| AAVBce.44 (SEQ ID NO: 45) | 258-265 | 322-327 | 377-381 | 447-455 | 460-471 | 483-500 | 522-534 | 540-552 | 575-587 | 698-706 | 443-595 |
| AAVBce.45 (SEQ ID NO: 46) | 258-265 | 322-327 | 377-381 | 447-455 | 460-471 | 483-500 | 522-534 | 540-552 | 575-587 | 698-706 | 443-595 |
| AAVBce.46 (SEQ ID NO: 47) | 258-265 | 322-327 | 377-381 | 447-455 | 460-471 | 483-500 | 522-534 | 540-552 | 575-587 | 698-706 | 443-595 |
| AAVBcy.20 (SEQ ID NO: 48) | 258-265 | 322-327 | 377-381 | 447-455 | 460-471 | 483-500 | 522-534 | 540-552 | 575-587 | 698-706 | 443-595 |
| AAVBcy.22 (SEQ ID NO: 49) | 258-265 | 322-327 | 377-381 | 447-455 | 460-471 | 483-500 | 522-534 | 540-552 | 575-587 | 698-706 | 443-595 |
| AAVBcy.23 (SEQ ID NO: 50) | 258-265 | 322-327 | 377-381 | 447-455 | 460-471 | 483-500 | 522-534 | 540-552 | 575-587 | 698-706 | 443-595 |
| AAVBba.26 (SEQ ID NO: 16) | 265-271 | 328-333 | 383-387 | 453-464 | 469-480 | 492-508 | 531-543 | 549-561 | 584-596 | 707-715 | 449-604 |
| AAVBba.27 (SEQ ID NO: 17) | 265-271 | 328-333 | 383-387 | 453-464 | 469-480 | 492-508 | 531-543 | 549-561 | 584-596 | 707-715 | 449-604 |
| AAVBba.29 (SEQ ID NO: 18) | 265-271 | 328-333 | 383-387 | 453-464 | 469-480 | 492-508 | 531-543 | 549-561 | 584-596 | 707-715 | 449-604 |

TABLE 2-continued

| AAV | VRI | VRII | VRIII | VRIV | GBS | VRV | VRVI | VRVII | VRVIII | VRIX | GHloop |
|---|---|---|---|---|---|---|---|---|---|---|---|
| AAVBba.30 | 265- | 328- | 383- | 453- | 469- | 492- | 531- | 549- | 584- | 707- | 449- |
| (SEQ ID NO: 19) | 271 | 333 | 387 | 464 | 480 | 508 | 543 | 561 | 596 | 715 | 604 |
| AAVBba.34 | 265- | 328- | 383- | 453- | 469- | 492- | 531- | 549- | 584- | 707- | 449- |
| (SEQ ID NO: 23) | 271 | 333 | 387 | 464 | 480 | 508 | 543 | 561 | 596 | 715 | 604 |
| AAVBba.35 | 265- | 328- | 383- | 453- | 469- | 492- | 531- | 549- | 584- | 707- | 449- |
| (SEQ ID NO: 24) | 271 | 333 | 387 | 464 | 480 | 508 | 543 | 561 | 596 | 715 | 604 |
| AAVBba.36 | 265- | 328- | 383- | 453- | 469- | 492- | 531- | 549- | 584- | 707- | 449- |
| (SEQ ID NO: 25) | 271 | 333 | 387 | 464 | 480 | 508 | 543 | 561 | 596 | 715 | 604 |
| AAVBba.37 | 265- | 328- | 383- | 453- | 469- | 492- | 531- | 549- | 584- | 707- | 449- |
| (SEQ ID NO: 26) | 271 | 333 | 387 | 464 | 480 | 508 | 543 | 561 | 596 | 715 | 604 |
| AAVBba.38 | 265- | 328- | 383- | 453- | 469- | 492- | 531- | 549- | 584- | 707- | 449- |
| (SEQ ID NO: 27) | 271 | 333 | 387 | 464 | 480 | 508 | 543 | 561 | 596 | 715 | 604 |
| AAVBba.41 | 265- | 328- | 383- | 453- | 469- | 492- | 531- | 549- | 584- | 707- | 449- |
| (SEQ ID NO: 28) | 271 | 333 | 387 | 464 | 480 | 508 | 543 | 561 | 596 | 715 | 604 |
| AAVBba.42 | 265- | 328- | 383- | 453- | 469- | 492- | 531- | 549- | 584- | 707- | 449- |
| (SEQ ID NO: 29) | 271 | 333 | 387 | 464 | 480 | 508 | 543 | 561 | 596 | 715 | 604 |
| AAVBba.43 | 265- | 328- | 383- | 453- | 469- | 492- | 531- | 549- | 584- | 707- | 449- |
| (SEQ ID NO: 30) | 271 | 333 | 387 | 464 | 480 | 508 | 543 | 561 | 596 | 715 | 604 |
| AAVBba.44 | 265- | 328- | 383- | 453- | 469- | 492- | 531- | 549- | 584- | 707- | 449- |
| (SEQ ID NO: 31) | 271 | 333 | 387 | 464 | 480 | 508 | 543 | 561 | 596 | 715 | 604 |
| AAVBrh.26 | 262- | 327- | 382- | 452- | 465- | 488- | 527- | 545- | 581- | 704- | 448- |
| (SEQ ID NO: 71) | 270 | 332 | 386 | 460 | 476 | 505 | 539 | 558 | 593 | 712 | 601 |
| AAVBrh.27 | 262- | 327- | 382- | 452- | 465- | 488- | 527- | 545- | 581- | 704- | 448- |
| (SEQ ID NO: 72) | 270 | 332 | 386 | 460 | 476 | 505 | 539 | 558 | 593 | 712 | 601 |
| AAVBrh.28 | 262- | 327- | 382- | 452- | 465- | 488- | 527- | 545- | 581- | 704- | 448- |
| (SEQ ID NO: 73) | 270 | 332 | 386 | 460 | 476 | 505 | 539 | 558 | 593 | 712 | 601 |
| AAVBrh.29 | 262- | 327- | 382- | 452- | 465- | 488- | 527- | 545- | 581- | 704- | 448- |
| (SEQ ID NO: 74) | 270 | 332 | 386 | 460 | 476 | 505 | 539 | 558 | 593 | 712 | 601 |
| AAVBrh.30 | 262- | 327- | 382- | 452- | 465- | 488- | 527- | 545- | 581- | 704- | 448- |
| (SEQ ID NO: 75) | 270 | 332 | 386 | 460 | 476 | 505 | 539 | 558 | 593 | 712 | 601 |
| AAVBrh.31 | 262- | 327- | 382- | 452- | 465- | 488- | 527- | 545- | 581- | 704- | 448- |
| (SEQ ID NO: 76) | 270 | 332 | 386 | 460 | 476 | 505 | 539 | 558 | 593 | 712 | 601 |
| AAVBrh.32 | 262- | 327- | 382- | 452- | 465- | 488- | 527- | 545- | 581- | 704- | 448- |
| (SEQ ID NO: 77) | 270 | 332 | 386 | 460 | 476 | 505 | 539 | 558 | 593 | 712 | 601 |
| AAVBrh.33 | 262- | 327- | 382- | 452- | 465- | 488- | 527- | 545- | 581- | 704- | 448- |
| (SEQ ID NO: 78) | 270 | 332 | 386 | 460 | 476 | 505 | 539 | 558 | 593 | 712 | 601 |
| AAVBfm.17 | 262- | 327- | 382- | 452- | 466- | 489- | 528- | 546- | 582- | 705- | 448- |
| (SEQ ID NO: 79) | 270 | 332 | 386 | 461 | 477 | 506 | 540 | 559 | 594 | 713 | 602 |
| AAVBfm.18 | 262- | 327- | 382- | 452- | 466- | 489- | 528- | 546- | 582- | 705- | 448- |
| (SEQ ID NO: 80) | 270 | 332 | 386 | 461 | 477 | 506 | 540 | 559 | 594 | 713 | 602 |
| AAVBfm.20 | 262- | 327- | 382- | 452- | 466- | 489- | 528- | 546- | 582- | 705- | 448- |
| (SEQ ID NO: 81) | 270 | 332 | 386 | 461 | 477 | 506 | 540 | 559 | 594 | 713 | 602 |
| AAVBfm.21 | 262- | 327- | 382- | 452- | 466- | 489- | 528- | 546- | 582- | 705- | 448- |
| (SEQ ID NO: 82) | 270 | 332 | 386 | 461 | 477 | 506 | 540 | 559 | 594 | 713 | 602 |
| AAVBfm.24 | 262- | 327- | 382- | 452- | 466- | 489- | 528- | 546- | 582- | 705- | 448- |
| (SEQ ID NO: 83) | 270 | 332 | 386 | 461 | 477 | 506 | 540 | 559 | 594 | 713 | 602 |
| AAVBfm.25 | 262- | 327- | 382- | 452- | 466- | 489- | 528- | 546- | 582- | 705- | 448- |
| (SEQ ID NO: 84) | 270 | 332 | 386 | 461 | 477 | 506 | 540 | 559 | 594 | 713 | 602 |
| AAVBfm.27 | 262- | 327- | 382- | 452- | 466- | 489- | 528- | 546- | 582- | 705- | 448- |
| (SEQ ID NO: 85) | 270 | 332 | 386 | 461 | 477 | 506 | 540 | 559 | 594 | 713 | 602 |
| AAVBfm.32 | 262- | 327- | 382- | 452- | 466- | 489- | 528- | 546- | 582- | 705- | 448- |
| (SEQ ID NO: 86) | 270 | 332 | 386 | 461 | 477 | 506 | 540 | 559 | 594 | 713 | 602 |
| AAVBfm.33 | 262- | 327- | 382- | 452- | 466- | 489- | 528- | 546- | 582- | 705- | 448- |
| (SEQ ID NO: 87) | 270 | 332 | 386 | 461 | 477 | 506 | 540 | 559 | 594 | 713 | 602 |
| AAVBfm.34 | 262- | 327- | 382- | 452- | 466- | 489- | 528- | 546- | 582- | 705- | 448- |
| (SEQ ID NO: 88) | 270 | 332 | 386 | 461 | 477 | 506 | 540 | 559 | 594 | 713 | 602 |
| AAVBfm.35 | 262- | 327- | 382- | 452- | 466- | 489- | 528- | 546- | 582- | 705- | 448- |
| (SEQ ID NO: 89) | 270 | 332 | 386 | 461 | 477 | 506 | 540 | 559 | 594 | 713 | 602 |

Transgene

The transgene is a nucleic acid sequence, heterologous to the vector sequences flanking the transgene, which encodes a polypeptide, protein, or other product, of interest. The nucleic acid coding sequence is operatively linked to regulatory components in a manner which permits transgene transcription, translation, and/or expression in a host cell.

The composition of the transgene sequence will depend upon the use to which the resulting vector will be put. For example, one type of transgene sequence includes a reporter sequence, which upon expression produces a detectable signal. Such reporter sequences include, without limitation, DNA sequences encoding β-lactamase, β-galactosidase (LacZ), alkaline phosphatase, thymidine kinase, green fluorescent protein (GFP), chloramphenicol acetyltransferase (CAT), luciferase, membrane bound proteins including, for example, CD2, CD4, CD8, the influenza hemagglutinin protein, and others well known in the art, to which high affinity antibodies directed thereto exist or can be produced by conventional means, and fusion proteins comprising a membrane bound protein appropriately fused to an antigen tag domain from, among others, hemagglutinin or Myc.

These coding sequences, when associated with regulatory elements which drive their expression, provide signals detectable by conventional means, including enzymatic, radiographic, colorimetric, fluorescence or other spectrographic assays, fluorescent activating cell sorting assays and immunological assays, including enzyme linked immunosorbent assay (ELISA), radioimmunoassay (RIA) and immunohistochemistry. For example, where the marker sequence is the LacZ gene, the presence of the vector carrying the signal is detected by assays for beta-galactosidase activity. Where the transgene is green fluorescent protein or luciferase, the vector carrying the signal may be measured visually by color or light production in a luminometer.

However, desirably, the transgene is a non-marker sequence encoding a product which is useful in biology and medicine, such as proteins, peptides, RNA, enzymes, dominant negative mutants, or catalytic RNAs. Desirable RNA molecules include tRNA, dsRNA, ribosomal RNA, catalytic RNAs, siRNA, small hairpin RNA, trans-splicing RNA, and antisense RNAs. One example of a useful RNA sequence is a sequence which inhibits or extinguishes expression of a targeted nucleic acid sequence in the treated animal. Typically, suitable target sequences include oncologic targets and viral diseases. See, for examples of such targets the oncologic targets and viruses identified below in the section relating to immunogens.

The transgene may be used to correct or ameliorate gene deficiencies, which may include deficiencies in which normal genes are expressed at less than normal levels or deficiencies in which the functional gene product is not expressed. A preferred type of transgene sequence encodes a therapeutic protein or polypeptide which is expressed in a host cell. The invention further includes using multiple transgenes, e.g., to correct or ameliorate a gene defect caused by a multi-subunit protein. In certain situations, a different transgene may be used to encode each subunit of a protein, or to encode different peptides or proteins. This is desirable when the size of the DNA encoding the protein subunit is large, e.g., for an immunoglobulin, the platelet-derived growth factor, or a dystrophin protein. In order for the cell to produce the multi-subunit protein, a cell is infected with the recombinant virus containing each of the different subunits. Alternatively, different subunits of a protein may be encoded by the same transgene. In this case, a single transgene includes the DNA encoding each of the subunits, with the DNA for each subunit separated by an internal ribozyme entry site (IRES). This is desirable when the size of the DNA encoding each of the subunits is small, e.g., the total size of the DNA encoding the subunits and the IRES is less than five kilobases. As an alternative to an IRES, the DNA may be separated by sequences encoding a 2A peptide, which self-cleaves in a post-translational event. See, e.g., Donnelly et al, *J. Gen. Virol.*, 78(Pt 1):13-21 (January 1997); Furler, et al, *Gene Ther.*, 8(11):864-873 (June 2001); Klump et al., *Gene Ther.*, 8(10):811-817 (May 2001). This 2A peptide is significantly smaller than an IRES, making it well suited for use when space is a limiting factor. More often, when the transgene is large, consists of multi-subunits, or two transgenes are co-delivered, rAAV carrying the desired transgene(s) or subunits are co-administered to allow them to concatamerize in vivo to form a single vector genome. In such an embodiment, a first AAV may carry an expression cassette which expresses a single transgene and a second AAV may carry an expression cassette which expresses a different transgene for co-expression in the host cell. However, the selected transgene may encode any biologically active product or other product, e.g., a product desirable for study.

Suitable transgenes may be readily selected by one of skill in the art. The selection of the transgene is not considered to be a limitation of this invention.

In some embodiments, the transgene is a heterologous protein, and this heterologous protein is a therapeutic protein. Exemplary therapeutic proteins include, but are not limited to, blood factors, such as β-globin, hemoglobin, tissue plasminogen activator, and coagulation factors; colony stimulating factors (CSF); interleukins, such as IL-1, IL-2, IL-3, IL-4, IL-5, IL-6, IL-7, IL-8, IL-9, etc.; growth factors, such as keratinocyte growth factor (KGF), stem cell factor (SCF), fibroblast growth factor (FGF, such as basic FGF and acidic FGF), hepatocyte growth factor (HGF), insulin-like growth factors (IGFs), bone morphogenetic protein (BMP), epidermal growth factor (EGF), growth differentiation factor-9 (GDF-9), hepatoma derived growth factor (HDGF), myostatin (GDF-8), nerve growth factor (NGF), neurotrophins, platelet-derived growth factor (PDGF), thrombopoietin (TPO), transforming growth factor alpha (TGF-α.), transforming growth factor beta (TGF-.β.), and the like; soluble receptors, such as soluble TNF-α. receptors, soluble VEGF receptors, soluble interleukin receptors (e.g., soluble IL-1 receptors and soluble type II IL-1 receptors), soluble .γ/δ T cell receptors, ligand-binding fragments of a soluble receptor, and the like; enzymes, such as α-glucosidase, imiglucarase, β-glucocerebrosidase, and alglucerase; enzyme activators, such as tissue plasminogen activator; chemokines, such as 1P-10, monokine induced by interferon-gamma (Mig), Groa/IL-8, RANTES, MIP-1α, MIP-1β., MCP-1, PF-4, and the like; angiogenic agents, such as vascular endothelial growth factors (VEGFs, e.g., VEGF121, VEGF165, VEGF-C, VEGF-2), glioma-derived growth factor, angiogenin, angiogenin-2; and the like; anti-angiogenic agents, such as a soluble VEGF receptor; protein vaccine; neuroactive peptides, such as nerve growth factor (NGF), bradykinin, cholecystokinin, gastin, secretin, oxytocin, gonadotropin-releasing hormone, beta-endorphin, enkephalin, substance P, somatostatin, prolactin, galanin, growth hormone-releasing hormone, bombesin, dynorphin, warfarin, neurotensin, motilin, thyrotropin, neuropeptide Y, luteinizing hormone, calcitonin, insulin, glucagons, vasopressin, angiotensin II, thyrotropin-releasing hormone, vasoactive intestinal peptide, a sleep peptide, and the like; thrombolytic agents; atrial natriuretic peptide; relaxin; glial fibrillary acidic protein; follicle stimulating hormone (FSH); human alpha-1 antitrypsin; leukemia inhibitory factor (LIF); tissue factors, luteinizing hormone; macrophage activating factors; tumor necrosis factor (TNF); neutrophil chemotactic factor (NCF); tissue inhibitors of metalloproteinases; vasoactive intestinal peptide; angiogenin; angiotropin; fibrin; hirudin; IL-1 receptor antagonists; and the like. Some other non-limiting examples of protein of interest include ciliary neurotrophic factor (CNTF); brain-derived neurotrophic factor (BDNF); neurotrophins 3 and 4/5 (NT-3 and 4/5); glial cell derived neurotrophic factor (GDNF); aromatic amino acid decarboxylase (AADC); hemophilia related clotting proteins, such as Factor VIII, Factor IX, Factor X; dystrophin, mini-dystrophin, or microdystrophin; lysosomal acid lipase; phenylalanine hydroxylase (PAH); glycogen storage disease-related enzymes, such as glucose-6-phosphatase, acid maltase, glycogen debranching enzyme, muscle glycogen phosphorylase, liver glycogen phosphorylase, muscle phosphofructokinase, phosphorylase kinase (e.g., PHKA2), glucose transporter (e.g., GLUT2), aldolase A, β-enolase, and glycogen synthase; lysosomal enzymes (e.g., beta-N-acetylhexosaminidase A); and any variants thereof.

In one preferred embodiment, the transgene encodes a protein that restores dystrophin function and is useful to treat Duchenne muscular dystrophy. Duchenne muscular dystrophy is a degenerative muscle disease caused by deletions or mutations in the X-linked gene that encodes the protein dystrophin. The absence of functional dystrophin causes muscle fiber degeneration, inflammation, and necrosis. The dystrophin gene is the largest known gene in the human genome, covering over 2.5 Mb of the human X chromosome. The dystrophin gene has 79 exons, transcription of which results in an 11 kb RNA transcript that encodes a protein consisting of 3,685 amino acids. A transgene encoding wild-type dystrophin exceeds the packing limit of known gene therapy vector systems. To overcome the packaging limitation, engineered synthetic versions of dystrophin have been generated. As used herein "microdystrophin" or "minidystrophin" refer to transgenes that encode truncation but functional dystrophins and have been described in WO2016177911, WO2015197869, and U.S. Patent Application Publication No. US2008249052 each of which is incorporated by reference in their entirety herein. Illustrative examples of microdystrophins include MD1 (a microdystrophin lacking spectrin like repeats 4 through 23 and lacking a C-terminal domain), MD3 (a codon optimized microdystrophin lacking spectrin-like repeats 4-23 while retaining spectrin-like repeats 1, 2, 3, and 24, and further retaining exons 70-75 of the C-terminal domain encoding the coiled-coil region helix 1 and 2 of the C-terminal domain), and MD4 (identical to human MD3, except that it retains the entire C-terminal domain (all of exons 70-79).

Regulatory Control Elements

The AAV vector also includes conventional control elements or sequences which are operably linked to the transgene in a manner which permits its transcription, translation and/or expression in a cell transfected with the plasmid vector or infected with the virus produced by the invention. As used herein, "operably linked" sequences include both expression control sequences that are contiguous with the gene of interest and expression control sequences that act in trans or at a distance to control the gene of interest.

Expression control sequences include appropriate transcription initiation, termination, promoter and enhancer sequences; efficient RNA processing signals such as splicing and polyadenylation (polyA) signals; sequences that stabilize cytoplasmic mRNA; sequences that enhance translation efficiency (i.e., Kozak consensus sequence); sequences that enhance protein stability; and when desired, sequences that enhance secretion of the encoded product. A great number of expression control sequences, including promoters which are native, constitutive, inducible and/or tissue-specific, are known in the art and may be utilized.

Examples of constitutive promoters include, without limitation, the retroviral Rous sarcoma virus (RSV) LTR promoter (optionally with the RSV enhancer), the cytomegalovirus (CMV) promoter (optionally with the CMV enhancer) (see, e.g., Boshart et al, Cell, 41:521-530 (1985)), the SV40 promoter, the dihydrofolate reductase promoter, the β-actin promoter, the phosphoglycerol kinase (PGK) promoter, and the EF1 promoter [Invitrogen]. Inducible promoters allow regulation of gene expression and can be regulated by exogenously supplied compounds, environmental factors such as temperature, or the presence of a specific physiological state, e.g., acute phase, a particular differentiation state of the cell, or in replicating cells only. Inducible promoters and inducible systems are available from a variety of commercial sources, including, without limitation, Invitrogen, Clontech and Ariad. Many other systems have been described and can be readily selected by one of skill in the art. Examples of inducible promoters regulated by exogenously supplied compounds, include, the zinc-inducible sheep metallothionine (MT) promoter, the dexamethasone (Dex)-inducible mouse mammary tumor virus (MMTV) promoter, the T7 polymerase promoter system [WO 98/10088]; the ecdysone insect promoter [No et al, Proc. Natl. Acad. Sci. USA, 93:3346-3351 (1996)], the tetracycline-repressible system [Gossen et al, Proc. Natl. Acad. Sci. USA, 89:5547-5551 (1992)], the tetracycline-inducible system [Gossen et al, Science, 268:1766-1769 (1995), see also Harvey et al, Curr. Opin. Chem. Biol., 2:512-518 (1998)], the RU486-inducible system [Wang et al, Nat. Biotech., 15:239-243 (1997) and Wang et al, Gene Ther., 4:432-441 (1997)] and the rapamycin-inducible system [Magari et al, J. Clin. Invest., 100:2865-2872 (1997)]. Other types of inducible promoters which may be useful in this context are those which are regulated by a specific physiological state, e.g., temperature, acute phase, a particular differentiation state of the cell, or in replicating cells only.

In another embodiment, the native promoter for the transgene will be used. The native promoter may be preferred when it is desired that expression of the transgene should mimic the native expression. The native promoter may be used when expression of the transgene must be regulated temporally or developmentally, or in a tissue-specific manner, or in response to specific transcriptional stimuli. In a further embodiment, other native expression control elements, such as enhancer elements, polyadenylation sites or Kozak consensus sequences may also be used to mimic the native expression.

Another embodiment of the transgene includes a gene operably linked to a tissue-specific promoter. For instance, if expression in skeletal muscle is desired, a promoter active in muscle should be used. These include the promoters from genes encoding skeletal β-actin, myosin light chain 2A, dystrophin, muscle creatine kinase, as well as synthetic muscle promoters with activities higher than naturally-occurring promoters (see Li et al., Nat. Biotech., 17:241-245 (1999)). Examples of promoters that are tissue-specific are known for liver (albumin, Miyatake et al., J. Virol., 71:5124-32 (1997); hepatitis B virus core promoter, Sandig et al., Gene Ther., 3:1002-9 (1996); alpha-fetoprotein (AFP), Arbuthnot et al., Hum. Gene Ther., 7:1503-14 (1996)), bone osteocalcin (Stein et al., Mol. Biol. Rep., 24:185-96 (1997)); bone sialoprotein (Chen et al., J. Bone Miner. Res., 11:654-64 (1996)), lymphocytes (CD2, Hansal et al., J. Immunol., 161:1063-8 (1998); immunoglobulin heavy chain; T cell receptor chain), neuronal such as neuron-specific enolase (NSE) promoter (Andersen et al., Cell. Mol. Neurobiol., 13:503-15 (1993)), neurofilament light-chain gene (Piccioli et al., Proc. Natl. Acad. Sci. USA, 88:5611-5 (1991)), and the neuron-specific vgf gene (Piccioli et al., Neuron, 15:373-84 (1995)), among others.

Optionally, plasmids carrying therapeutically useful transgenes may also include selectable markers or reporter genes may include sequences encoding geneticin, hygromicin or purimycin resistance, among others. Such selectable reporters or marker genes (preferably located outside the viral genome to be rescued by the method of the invention) can be used to signal the presence of the plasmids in bacterial cells, such as ampicillin resistance. Other components of the plasmid may include an origin of replication. Selection of these and other promoters and vector elements are conventional and many such sequences are available [see, e.g., Sambrook et al, and references cited therein].

Methods for Producing Recombinant AAVs

The present disclosure provides materials and methods for producing recombinant AAVs in insect or mammalian cells. In some embodiments, the viral construct further comprises a promoter and a restriction site downstream of the promoter to allow insertion of a polynucleotide encoding one or more proteins of interest, wherein the promoter and the restriction site are located downstream of the 5' AAV ITR and upstream of the 3' AAV ITR. In some embodiments, the viral construct further comprises a posttranscriptional regulatory element downstream of the restriction site and upstream of the 3' AAV ITR. In some embodiments, the viral construct further comprises a polynucleotide inserted at the restriction site and operably linked with the promoter, where the polynucleotide comprises the coding region of a protein of interest. As a skilled artisan will appreciate, any one of the AAV vector disclosed in the present application can be used in the method as the viral construct to produce the recombinant AAV.

In some embodiments, the helper functions are provided by one or more helper plasmids or helper viruses comprising adenoviral or baculoviral helper genes. Non-limiting examples of the adenoviral or baculoviral helper genes include, but are not limited to, E1A, E1B, E2A, E4 and VA, which can provide helper functions to AAV packaging.

Helper viruses of AAV are known in the art and include, for example, viruses from the family Adenoviridae and the family Herpesviridae. Examples of helper viruses of AAV include, but are not limited to, SAdV-13 helper virus and SAdV-13-like helper virus described in US Publication No. 20110201088 (the disclosure of which is incorporated herein by reference), helper vectors pHELP (Applied Viromics). A skilled artisan will appreciate that any helper virus or helper plasmid of AAV that can provide adequate helper function to AAV can be used herein.

In some embodiments, the AAV cap genes are present in a plasmid. The plasmid can further comprise an AAV rep gene. The cap genes and/or rep gene from any AAV serotype (including, but not limited to, AAV1, AAV2, AAV4, AAV5, AAV6, AAV7, AAV8, AAV9, AAV10, AAV11, AAV12, AAV13 and any variants thereof) can be used herein to produce the recombinant AAV. In some embodiments, the AAV cap genes encode a capsid from serotype 1, serotype 2, serotype 4, serotype 5, serotype 6, serotype 7, serotype 8, serotype 9, serotype 10, serotype 11, serotype 12, serotype 13 or a variant thereof.

In some embodiments, the insect or mammalian cell can be transfected with the helper plasmid or helper virus, the viral construct and the plasmid encoding the AAV cap genes; and the recombinant AAV virus can be collected at various time points after co-transfection. For example, the recombinant AAV virus can be collected at about 12 hours, about 24 hours, about 36 hours, about 48 hours, about 72 hours, about 96 hours, about 120 hours, or a time between any of these two time points after the co-transfection.

Recombinant AAV can also be produced using any conventional methods known in the art suitable for producing infectious recombinant AAV. In some instances, a recombinant AAV can be produced by using an insect or mammalian cell that stably expresses some of the necessary components for AAV particle production. For example, a plasmid (or multiple plasmids) comprising AAV rep and cap genes, and a selectable marker, such as a neomycin resistance gene, can be integrated into the genome of the cell. The insect or mammalian cell can then be co-infected with a helper virus (e.g., adenovirus or baculovirus providing the helper functions) and the viral vector comprising the 5' and 3' AAV ITR (and the nucleotide sequence encoding the heterologous protein, if desired). The advantages of this method are that the cells are selectable and are suitable for large-scale production of the recombinant AAV. As another non-limiting example, adenovirus or baculovirus rather than plasmids can be used to introduce rep and cap genes into packaging cells. As yet another non-limiting example, both the viral vector containing the 5' and 3' AAV LTRs and the rep-cap genes can be stably integrated into the DNA of producer cells, and the helper functions can be provided by a wild-type adenovirus to produce the recombinant AAV.

Cell Types Used in AAV Production

The viral particles comprising the AAV vectors of the invention may be produced using any invertebrate cell type which allows for production of AAV or biologic products and which can be maintained in culture. For example, the insect cell line used can be from *Spodoptera frugiperda*, such as Sf9, SF21, SF900+, *drosophila* cell lines, mosquito cell lines, e.g., *Aedes albopictus* derived cell lines, domestic silkworm cell lines, e.g. Bombyxmori cell lines, *Trichoplusia* rti cell lines such as High Five cells or Lepidoptera cell lines such as Ascalapha *odorata* cell lines. Preferred insect cells are cells from the insect species which are susceptible to baculovirus infection, including High Five, Sf9, Se301, SeIZD2109, SeUCR1, Sf900+, Sf21, BTI-TN-5B1-4, MG-1, Tn368, HzAml, BM-N, Ha2302, Hz2E5 and Ao38.

Baculoviruses are enveloped DNA viruses of arthropods, two members of which are well known expression vectors for producing recombinant proteins in cell cultures. Baculoviruses have circular double-stranded genomes (80-200 kbp) which can be engineered to allow the delivery of large genomic content to specific cells. The viruses used as a vector are generally *Autographa californica* multicapsid nucleopolyhedrovirus (AcMNPV) or *Bombyx mori* (BmNPV) (Kato et al., 2010).

Baculoviruses are commonly used for the infection of insect cells for the expression of recombinant proteins. In particular, expression of heterologous genes in insects can be accomplished as described in for instance U.S. Pat. No. 4,745,051; Friesen et al (1986); EP 127,839; EP 155,476; Vlak et al (1988); Miller et al (1988); Carbonell et al (1988); Maeda et al (1985); Lebacq-Verheyden et al (1988); Smith et al (1985); Miyajima et al (1987); and Martin et al (1988). Numerous baculovirus strains and variants and corresponding permissive insect host cells that can be used for protein production are described in Luckow et al (1988), Miller et al (1986); Maeda et al (1985) and McKenna (1989).

In another aspect of the invention, the methods of the invention are also carried out with any mammalian cell type which allows for replication of AAV or production of biologic products, and which can be maintained in culture. Preferred mammalian cells used can be HEK293, HeLa, CHO, NSO, SP2/0, PER.C6, Vero, RD, BHK, HT 1080, A549, Cos-7, ARPE-19 and MRC-5 cells.

Production of Heterologous Proteins In Vitro

As a non-limiting example, the recombinant AAV disclosed herein can be used to produce a protein of interest in vitro, for example, in a cell culture. As one non-limiting example, in some embodiments, a method for producing a protein of interest in vitro, where the method includes providing a recombinant AAV comprising a nucleotide sequence encoding the heterologous protein; and contacting the recombinant AAV with a cell in a cell culture, whereby the recombinant AAV expresses the protein of interest in the cell. The size of the nucleotide sequence encoding the protein of interest can vary. For example, the nucleotide sequence can be at least about 1.4 kb, at least about 1.5 kb, at least about 1.6 kb, at least about 1.7 kb, at least about 1.8 kb, at least about 2.0 kb, at least about 2.2 kb, at least about 2.4 kb, at least about 2.6 kb, at least about 2.8 kb, at least about 3.0 kb, at least about 3.2 kb, at least about 3.4 kb, at least about 3.5 kb in length, at least about 4.0 kb in length, at least about 5.0 kb in length, at least about 6.0 kb in length, at least about 7.0 kb in length, at least about 8.0 kb in length, at least about 9.0 kb in length, or at least about 10.0 kb in length. In some embodiments, the nucleotide is at least about 1.4 kb in length.

Production of Heterologous Proteins In Vivo

The recombinant AAV disclosed herein can be used to produce a protein of interest in vivo, for example in an animal such as a mammal. Some embodiments provide a method for producing a protein of interest in vivo, where the method includes providing a recombinant AAV comprising a nucleotide sequence encoding the protein of interest; and administering the recombinant AAV to the subject, whereby the recombinant AAV expresses the protein of interest in the subject. The subject can be, in some embodiments, a non-human mammal, for example, a monkey, a dog, a cat, a mouse, or a cow. The size of the nucleotide sequence encoding the protein of interest can vary. For example, the nucleotide sequence can be at least about 1.4 kb, at least about 1.5 kb, at least about 1.6 kb, at least about 1.7 kb, at least about 1.8 kb, at least about 2.0 kb, at least about 2.2 kb, at least about 2.4 kb, at least about 2.6 kb, at least about 2.8 kb, at least about 3.0 kb, at least about 3.2 kb, at least about 3.4 kb, at least about 3.5 kb in length, at least about 4.0 kb in length, at least about 5.0 kb in length, at least about 6.0 kb in length, at least about 7.0 kb in length, at least about 8.0 kb in length, at least about 9.0 kb in length, or at least about 10.0 kb in length. In some embodiments, the nucleotide is at least about 1.4 kb in length.

Therapeutic Uses

The recombinant AAV produced by the methods described can be used to express one or more therapeutic proteins to treat various diseases or disorders. Non-limiting examples of the diseases include cancer such as carcinoma, sarcoma, leukemia, lymphoma; and autoimmune diseases such as multiple sclerosis. Non-limiting examples of carcinomas include esophageal carcinoma; hepatocellular carcinoma; basal cell carcinoma, squamous cell carcinoma (various tissues); bladder carcinoma, including transitional cell carcinoma; bronchogenic carcinoma; colon carcinoma; colorectal carcinoma; gastric carcinoma; lung carcinoma, including small cell carcinoma and non-small cell carcinoma of the lung; adrenocortical carcinoma; thyroid carcinoma; pancreatic carcinoma; breast carcinoma; ovarian carcinoma; prostate carcinoma; adenocarcinoma; sweat gland carcinoma; sebaceous gland carcinoma; papillary carcinoma; papillary adenocarcinoma; cystadenocarcinoma; medullary carcinoma; renal cell carcinoma; ductal carcinoma in situ or bile duct carcinoma; choriocarcinoma; seminoma; embryonal carcinoma; Wilm's tumor; cervical carcinoma; uterine carcinoma; testicular carcinoma; osteogenic carcinoma; epithelieal carcinoma; and nasopharyngeal carcinoma. Non-limiting examples of sarcomas include fibrosarcoma, myxosarcoma, liposarcoma, chondrosarcoma, chordoma, osteogenic sarcoma, osteosarcoma, angiosarcoma, endotheliosarcoma, lymphangiosarcoma, lymphangioendotheliosarcoma, synovioma, mesothelioma, Ewing's sarcoma, leiomyosarcoma, rhabdomyosarcoma, and other soft tissue sarcomas. Non-limiting examples of solid tumors include glioma, astrocytoma, medulloblastoma, craniopharyngioma, ependymoma, pinealoma, hemangioblastoma, acoustic neuroma, oligodendroglioma, menangioma, melanoma, neuroblastoma, and retinoblastoma. Non-limiting examples of leukemias include chronic myeloproliferative syndromes; acute myelogenous leukemias; chronic lymphocytic leukemias, including B-cell CLL, T-cell CLL prolymphocytic leukemia, and hairy cell leukemia; and acute lymphoblastic leukemias. Examples of lymphomas include, but are not limited to, B-cell lymphomas, such as Burkitt's lymphoma; Hodgkin's lymphoma; and the like. Other non-liming examples of the diseases that can be treated using the AAV vectors, recombinant viruses and methods disclosed herein include genetic disorders including sickle cell anemia, cystic fibrosis, lysosomal acid lipase (LAL) deficiency 1, Tay-Sachs disease, Phenylketonuria, Mucopolysaccharidoses, Glycogen storage diseases (GSD, e.g., GSD types I, II, III, IV, V, VI, VII, VIII, IX, X, XI, XII, XIII, and XIV), Galactosemia, muscular dystrophy (e.g., Duchenne muscular dystrophy), and hemophilia such as hemophilia A (classic hemophilia) and hemophilia B (Christmas Disease).

The amount of the heterologous protein expressed in the subject (e.g., the serum of the subject) can vary. For example, in some embodiments the protein can be expressed in the serum of the subject in the amount of at least about 9 µg/ml, at least about 10 µg/ml, at least about 50 µg/ml, at least about 100 µg/ml, at least about 200 µg/ml, at least about 300 µg/ml, at least about 400 µg/ml, at least about 500 µg/ml, at least about 600 µg/ml, at least about 700 µg/ml, at least about 800 µg/ml, at least about 900 µg/ml, or at least about 1000 µg/ml. In some embodiments, the protein of interest is expressed in the serum of the subject in the amount of about 9 µg/ml, about 10 µg/ml, about 50 µg/ml, about 100 µg/ml, about 200 µg/ml, about 300 µg/ml, about 400 µg/ml, about 500 µg/ml, about 600 µg/ml, about 700 µg/ml, about 800 µg/ml, about 900 µg/ml, about 1000 µg/ml, about 1500 µg/ml, about 2000 µg/ml, about 2500 µg/ml, or a range between any two of these values. A skilled artisan will understand that the expression level in which a protein of interest is needed for the method to be effective can vary depending on non-limiting factors such as the particular protein of interest and the subject receiving the treatment, and an effective amount of the protein can be readily determined by a skilled artisan using conventional methods known in the art without undue experimentation.

EXAMPLES

Example 1

Isolation of Novel Naturally-Occurring Capsid Proteins

Novel naturally-occurring capsid proteins were isolated from the liver tissue from various mammals. Fresh liver tissue (porcine) was obtained from local farmers. Frozen liver tissue (baboon, cynomolgous macaque, marmoset, and crab-eating macaque) was obtained from Texas Biomedical or the New England Primate Research Center. Genomic DNA was prepared from liver tissue using the DNeasy Blood & Tissue kit (Qiagen catalog #69504).

Polymerase chain reaction (PCR) was carried out on the genomic DNA using the following primers: primer rep-1397-F (5'-GTGCCCTTTTACGGCTGCGT-GAACTGGACCAATGAAAACTTTCC-3'SEQ ID NO:158) and primer cap-2872-R (5'-CCGACG-GAGTGGGCAATGCCTCAGGAAATTGGCATTG CGATTCC-3' SEQ ID NO:159) under the following conditions: initial incubation: 97° C., 120 sec, denaturation step: 97° C., 15 sec, annealing step: 58° C., 60° C., or 62° C., 15 sec, extension step: 72° C., 240 sec. The denaturation, annealing, and extension steps were performed for 35 cycles. Then the reaction was incubated at 72° C., 7 min and stored at 4° C. until analyzed. The PCR products were separated by electrophoresis on 1% agarose gels, isolated using the Gel Extraction Kit (Qiagen catalog #28704), and cloned into pCR4-TOPO-TA (Invitrogen catalog #450030)

according to the manufacturer's instructions. After transformation of E. coli, NEB5a cells, DNA was prepared from ampicillin resistant colonies and sequenced from both ends to determine if the insert encoded an AAV-related sequence.

If the inserts in pCR4-TOPO TA were related to AAV sequences, sequence-specific primers were designed to the rep portion of the sequence to perform "around the episome PCR" (hereinafter "ATE PCR") to obtain a complete capsid gene. ATE PCR is based on the notion that persistent AAV genomes forms circular episomes in animal tissues. Accordingly, one can use a "divergent" set of primers corresponding to a sequence in the rep gene to perform polymerase chain reactions to isolate most or all of any AAV sequence that may exist in that episome but in particular one could isolate a complete contiguous capsid gene. Multimers of episomes can form, for example by homologous recombination, and in that case it is possible to isolate more than one capsid gene (which usually are not the same) from a single ATE PCR reaction.

An ATE PCR was carried-out in a standard polymerase chain reaction instrument using a 2-step program as follows: initial incubation: 95° C., 240 sec, denaturation step: 95° C., 30 sec annealing/extension step: 72° C., 300 sec. The denaturation and combined annealing/extension steps were performed for 40 cycles. The reaction was then incubated at 72° C., 7 min and stored at 4° C. until analyzed. The PCR products were electrophoresed on 1% agarose gels. PCR products that were the length of multimers of an AAV genome (~4.5 kilobases) were excised from the gel, purified using the QIAquick Gel Extraction Kit (Qiagen catalog #28704), and cloned into pCR4-TOPO-TA (Invitrogen catalog #450030) according to the manufacturer's instructions. After transformation of E. coli, NEB5a cells, DNA was prepared from ampicillin resistant colonies and the entire sequence of the insert was determined.

If the 2-step program described above did not produce PCR products of the correct size the following 3-step program was used: Initial incubation: 95° C., 240 sec, Denaturation step: 95° C., 30 sec Annealing step: 62° C., 64° C., 66° C., or 68° C., 30 sec, Extension step: 72° C., 300 sec. The denaturation, annealing, and extension steps were performed for 40 cycles. Then the reaction was incubated at 72° C., 7 min and stored at 4° C. until analyzed as above.

Once complete insert sequences in pCR4-TOPO TA were determined they were identified as being AAV capsid genes using the BLAST algorithm (available at the NCBI website). Their relationship to known AAVs was determined using various nucleotide or amino acid sequence alignment programs such as Clustal Omega (available at the EBI web site) or Vector NTI (Invitrogen, Inc.).

To produce AAV, the unique AAV capsid genes were subcloned into an expression plasmid (pAAV-RC; Agilent, Inc.), then transfected into 293 cells along with a vector (pAAV luciferase) and adenovirus helper plasmid (pHELPER; Agilent, Inc.). AAV production was allowed to occur for 3 days and then crude lysates were made by freeze-thawing the cells three times. Debris was pelleted and the supernatant (crude AAV) was titered by Q-PCR to determine a genomic titer (which confirms the capsid is capable of assembly and DNA packaging) and then used to assess transduction by the AAVs on various cells.

The VP1 amino acid sequences of the novel mammalian tissue-derived AAV capsid proteins identified are herein described as SEQ ID NOS:15-89. The locations of the associated VP2 and VP3 regions are also herein described. The present invention is directed to (i) isolated AAV capsid proteins having at least 95%, 96%, 97%, 98% or 99% sequence identity to any of the VP1 capsid sequences of SEQ ID NOS:15-89, or the VP2 or VP3 regions of any of the capsid sequences of SEQ ID NOS:15-89, or (ii) isolated AAV capsid proteins comprising or consisting of any of the VP1 capsid sequences of SEQ ID NOS:15-89, or the VP2 or VP3 regions of any of the capsid sequences of SEQ ID NOS:15-89. The invention is also directed to an AAV particle that comprises any of the above described AAV capsid proteins, wherein the AAV particle further comprises either (i) a nucleic acid having AAV inverted terminal repeats and a transgene comprising a heterologous gene operably linked to regulatory sequences that direct expression of the heterologous gene in a host cell, or (ii) a nucleic acid comprising a heterologous gene operably linked to regulatory sequences that control expression of the heterologous gene in a host cell.

Example 2

Generation of Engineered Chimeric Capsid Proteins

Alignment of the primary VP1 amino acid sequence of various AAV serotypes identified that conserved and variable regions exist in AAV capsid proteins. This analysis identified nine variable regions (denoted herein as VR I-VR IX) in the capsid protein amino acid sequence. In the present invention, one or more of the nine variable regions of a backbone ("recipient") capsid protein and/or the glycan binding sequence (GBS) region or GH loop region were substituted with the corresponding variable region(s), GBS or GH loop regions from a donor capsid protein having a different amino acid sequence than the recipient. The pHLP19-AAV-BMRNX expression plasmid vector was used to generate the chimeric capsid proteins. Rep proteins from AAV2 were used consistently for all different capsid proteins (VP1, VP2 and VP3). Engineered capsid genes were subcloned into pHLP19-AAV-BMRNX using unique SwaI and AgeI restriction enzyme sites in the plasmid and that also flank each capsid gene.

Table 3 provides exemplary engineered chimeric capsid proteins that were generated as described here and tested as described in Example 3 below. "Backbone Sequence" refers to the backbone VP1 capsid sequence into which VR, GBS and/or GH loop region(s) are substituted or swapped, i.e., the "recipient." "Donor Sequence" refers to the VP1 capsid sequence from which the variable, GBS and/or GH loop region(s) are obtained and swapped into the recipient backbone sequence, i.e., the "donor." The "VR" substitution refers to a substitution where all nine variable regions (VR I-VR IX) from the donor are swapped into the recipient to produce the resulting engineered chimeric capsid. The "VRGBS" substitution refers to a substitution where all nine variable regions (VR I-VR IX) and the GBS sequence are swapped from the donor into the recipient to produce the resulting engineered chimeric capsid. The "GH" substitution refers to a substitution where only the GH loop region is swapped from the donor into the recipient to produce the resulting engineered chimeric capsid. The "GH loop" sequence comprises variable regions VR IV through VR VIII, including the encompassed GBS sequence and all conserved sequence that is interspersed between those regions from the donor. The "VRGH" substitution refers to a substitution in which all nine variable regions (VR I-VR IX) and the GH loop sequence (including the encompassed GBS sequence and the conserved sequence that is interspersed between those regions from the donor sequence) are swapped from the donor to the recipient. The "PHP" modification refers to an insertion of the seven amino acid sequence TLAVPFK (SEQ ID NO: 160) into the chimeric capsid sequence to enhance targeting to brain tissue as described in Deverman et al., Nature Biotechnology 34:204-209 (2016).

TABLE 3

| Name/ SEQ ID NO: | Backbone Sequence | Donor Sequence | Substitution | VP1 Amino Acid Sequence |
|---|---|---|---|---|
| AAVrh.10_9GH SEQ ID NO: 90 | AAVrh.10 | AAV9 | GH | MAADGYLPDWLEDNLSEGIREWWDLKPGAPKPKANQQKQD DGRGLVLPGYKYLGPFNGLDKGEPVNAADAAALEHDKAYD QQLKAGDNPYLRYNHADAEFQERLQEDTSFGGNLGRAVFQ AKKRVLEPLGLVEEGAKTAPGKKRPVEPSPQRSPDSSTGI GKKGQQPAKKRLNFGQTGDSESVPDPQPIGEPPAGPSGLG SGTMAAGGGAPMADNNEGADGVGSSSGNWHCDSTWLGDRV ITTSTRTWALPTYNNHLYKQISNGTSGGSTNDNTYFGYST PWGYFDFNRFHCHFSPRDWQRLINNNWGFRPKRLNFKLFN IQVKEVTQNEGTKTIANNLTSTIQVFTDSEYQLPYVLGSA HQGCLPPFPADVFMIPQYGYLTLNNGSQAVGRSSFYCLEY FPSQMLRTGNNFEFSYQFEDVPFHSSYAHSQSLDRLMNPL IDQYLYYLSKTINGSGQNQQTLKFSVAGPSNMAVQGRNYI PGPSYRQQRVSTTVTQNNNSEFAWPGASSWALNGRNSLMN PGPAMASHKEGEDRFFPLSGSLIFGKQGTGRDNVDADKVM ITNEEEIKTTNPVATESYGQVATNHQSAQAQAQTGWVQNQ GILPGMVWQNRDVYLQGPIWAKIPHTDGNFHPSPLMGGFG LKHPPPQILIKNTPVPADPPTTFSQAKLASFITQYSTGQV SVEIEWELQKENSKRWNPEIQYTSNYYKSTNVDFAVNTDG TYSEPRPIGTRYLTRNL |
| AAVrh.10_9VRGBS SEQ ID NO: 91 | AAVrh.10 | AAV9 | VRGBS | MAADGYLPDWLEDNLSEGIREWWDLKPGAPKPKANQQKQD DGRGLVLPGYKYLGPFNGLDKGEPVNAADAAALEHDKAYD QQLKAGDNPYLRYNHADAEFQERLQEDTSFGGNLGRAVFQ AKKRVLEPLGLVEEGAKTAPGKKRPVEPSPQRSPDSSTGI GKKGQQPAKKRLNFGQTGDSESVPDPQPIGEPPAGPSGLG SGTMAAGGGAPMADNNEGADGVGSSSGNWHCDSTWLGDRV ITTSTRTWALPTYNNHLYKQISNSTSGGSSNDNTYFGYST PWGYFDFNRFHCHFSPRDWQRLINNNWGFRPKRLNFKLFN IQVKEVTDNNGVKTIANNLTSTIQVFTDSEYQLPYVLGSA HQGCLPPFPADVFMIPQYGYLTLNDGSQAVGRSSFYCLEY FPSQMLRTGNNFEFSYQFEDVPFHSSYAHSQSLDRLMNPL IDQYLYYLSRTINGSGQNQQTLKFSVAGPSNMAVQAKNWL PGPCYRQQRVSTTVTQNNNSEFAWPGATKYHLNGRDSLVN PGVAMASHKEGEDRFFPLSGSLMFGKQGTGRDNVDADKVM LTSEEEIKTTNPVATEQYGVVATNHQSAQAQAQTGWVQNQ GILPGMVWQNRDVYLQGPIWAKIPHTDGNFHPSPLMGGFG LKHPPPQILIKNTPVPADPPTTFSQAKLASFITQYSTGQV SVEIEWELQKENSKRWNPEIQYTSNYYKSNNVEFAVNTEG TYSEPRPIGTRYLTRNL |
| AAVBce.36_9GH SEQ ID NO: 92 | AAVBce.36 | AAV9 | GH | MAADGYLPDWLEDNLSEGIREWWALKPGAPQPKANQQKQD DGRGLVLPGYKYLGPFNGLDKGEPVNEADAAALEHDKAYD QQLKAGDNPYLRYNHADAEFQERLQEDTSFGGNLGRAVFQ AKKRVLEPLGLVEEAAKTAPGKKRPVDSPDSTSGIGKKGQ QPARKRLNFGQTGDAESVPDPQPIGEPPAAPSGLGSGTMA AGGGAPMADNNEGADGVGNASGNWHCDSTWLGNRVITTST RTWALPTYNNHLYKQISSSSSGATNDNHYFGYSTPWGYFD FNRFHCHFSPRDWQRLINNNWGFRPKRLRFKLFNIQVKEV TTNDGVTTIANNLTSTVQVFSDSEYQLPYVLGSAHQGCLP PFPADVFMIPQYGYLTLNNGSQSVGRSSFYCLEYFPSQML RTGNNFEFSYEFEDVPFHSSYAHSQSLDRLMNPLIDQYLY YLSKTINGSGQNQQTLKFSVAGPSNMAVQGRNYIPGPSYR QQRVSTTVTQNNNSEFAWPGASSWALNGRNSLMNPGPAMA SHKEGEDRFFPLSGSLIFGKQGTGRDNVDADKVMITNEEE IKTTNPVATESYGQVATNHQSAQAQAQTGWVQNQGILPGM VWQNRDVYLQGPIWAKIPHTDGNFHPSPLMGGFGLKHPPP QILIKNTPVPANPPETFTPAKFASFITQYSTGQVSVEIEW ELQKENSKRWNPEIQYTSNYDKQTGVDFAVDTQGVYSEPR PIGTRYLTRNL |
| AAVBce.36_9VRGBS SEQ ID NO: 93 | AAVBce.36 | AAV9 | VRGBS | MAADGYLPDWLEDNLSEGIREWWALKPGAPQPKANQQKQD DGRGLVLPGYKYLGPFNGLDKGEPVNEADAAALEHDKAYD QQLKAGDNPYLRYNHADAEFQERLQEDTSFGGNLGRAVFQ AKKRVLEPLGLVEEAAKTAPGKKRPVDSPDSTSGIGKKGQ QPARKRLNFGQTGDAESVPDPQPIGEPPAAPSGLGSGTMA AGGGAPMADNNEGADGVGNASGNWHCDSTWLGNRVITTST RTWALPTYNNHLYKQISNSTSGGSSNDNHYFGYSTPWGYF DFNRFHCHFSPRDWQRLINNNWGFRPKRLRFKLFNIQVKE VTDNNGVKTIANNLTSTVQVFSDSEYQLPYVLGSAHQGCL PPFPADVFMIPQYGYLTLNDGSQAVGRSSFYCLEYFPSQM LRTGNNFEFSYEFEDVPFHSSYAHSQSLDRLMNPLIDQYL YYLARTINGSGQNQQTLKFSVAGPSNMAVQSKNWLPGPCF RQQRVSTTVTQNNNSEFAWPGATKYHLNGRNSLTNPGVPM ASHKEGEDRFFPLSGSLVFGKQGTGRDNVDADKVLMTDEE EIKATNPVATEEYGVVATNHQSAQAQAQTGWVQNQGILPG MVWQNRDVYLQGPIWAKIPHTDGNFHPSPLMGGFGLKHPP PQILIKNTPVPANPPETFTPAKFASFITQYSTGQVSVEIE |

TABLE 3-continued

| Name/<br>SEQ ID NO: | Backbone<br>Sequence | Donor<br>Sequence | Substitution | VP1 Amino Acid Sequence |
|---|---|---|---|---|
| | | | | WELQKENSKRWNPEIQYTSNYYKSNNVEFAVNTEGVYSEP<br>RPIGTRYLTRNL |
| AAV7_9VRGBS<br>SEQ ID NO: 94 | AAV7 | AAV9 | VRGBS | MAADGYLPDWLEDNLSEGIREWWDLKPGAPKPKANQQKQD<br>NGRGLVLPGYKYLGPFNGLDKGEPVNAADAAALEHDKAYD<br>QQLKAGDNPYLRYNHADAEFQERLQEDTSFGGNLGRAVFQ<br>AKKRVLEPLGLVEEGAKTAPAKKRPVEPSPQRSPDSSTGI<br>GKKGQQPARKRLNFGQTGDSESVPDPQPLGEPPAAPSSVG<br>SGTVAAGGGAPMADNNEGADGVGNASGNWHCDSTWLGDRV<br>ITTSTRTWALPTYNNHLYKQISNSTSGGSSNDNTYFGYST<br>PWGYFDFNRFHCHFSPRDWQRLINNNWGFRPKKLRFKLFN<br>IQVKEVTDNNGVKTIANNLTSTIQVFSDSEYQLPYVLGSA<br>HQGCLPPFPADVFMIPQYGYLTLNDGSQAVGRSSFYCLEY<br>FPSQMLRTGNNFEFSYSFEDVPFHSSYAHSQSLDRLMNPL<br>IDQYLYYLARTINGSGQNQQTLKFSVAGPSNMAVQAKNWL<br>PGPCFRQQRVSTTVTQNNNSEFAWPGATKYHLNGRNSLVN<br>PGVAMASHKEGEDRFFPLSGSLIFGKQGTGRDNVDADKLM<br>TNEEEIRPTNPVATEEYGIVATNHQSAQAQAQTGWVQNQG<br>ILPGMVWQNRDVYLQGPIWAKIPHTDGNFHPSPLMGGFGL<br>KHPPPQILIKNTPVPANPPEVFTPAKFASFITQYSTGQVS<br>VEIEWELQKENSKRWNPEIQYTSNFYKSNNVEFAVNTEGV<br>YSEPRPIGTRYLTRNL |
| AAV7_9GH<br>SEQ ID NO: 95 | AAV7 | AAV9 | GH | MAADGYLPDWLEDNLSEGIREWWDLKPGAPKPKANQQKQD<br>NGRGLVLPGYKYLGPFNGLDKGEPVNAADAAALEHDKAYD<br>QQLKAGDNPYLRYNHADAEFQERLQEDTSFGGNLGRAVFQ<br>AKKRVLEPLGLVEEGAKTAPAKKRPVEPSPQRSPDSSTGI<br>GKKGQQPARKRLNFGQTGDSESVPDPQPLGEPPAAPSSVG<br>SGTVAAGGGAPMADNNEGADGVGNASGNWHCDSTWLGDRV<br>ITTSTRTWALPTYNNHLYKQISSETAGSTNDNTYFGYSTP<br>WGYFDFNRFHCHFSPRDWQRLINNNWGFRPKKLRFKLFNI<br>QVKEVTTNDGVTTIANNLTSTIQVFSDSEYQLPYVLGSAH<br>QGCLPPFPADVFMIPQYGYLTLNNGSQSVGRSSFYCLEYF<br>PSQMLRTGNNFEFSYSFEDVPFHSSYAHSQSLDRLMNPLI<br>DQYLYYLSKTINGSGQNQQTLKFSVAGPSNMAVQGRNYIP<br>GPSYRQQRVSTTVTQNNNSEFAWPGASSWALNGRNSLMNP<br>GPAMASHKEGEDRFFPLSGSLIFGKQGTGRDNVDADKVMI<br>TNEEEIKTTNPVATESYGQVATNHQSAQAQAQTGWVQNQG<br>ILPGMVWQNRDVYLQGPIWAKIPHTDGNFHPSPLMGGFGL<br>KHPPPQILIKNTPVPANPPEVFTPAKFASFITQYSTGQVS<br>VEIEWELQKENSKRWNPEIQYTSNFEKQTGVDFAVDSQGV<br>YSEPRPIGTRYLTRNL |
| AAV6.2_9VRGBS<br>SEQ ID NO: 96 | AAV6.2 | AAV9 | VRGBS | MAADGYLPDWLEDNLSEGIREWWDLKPGAPKPKANQQKQD<br>DGRGLVLPGYKYLGPFNGLDKGEPVNAADAAALEHDKAYD<br>QQLKAGDNPYLRYNHADAEFQERLQEDTSFGGNLGRAVFQ<br>AKKRVLEPLGLVEEGAKTAPGKKRPVEQSPQEPDSSSGIG<br>KTGQQPAKKRLNFGQTGDSESVPDPQPLGEPPATPAAVGP<br>TTMASGGGAPMADNNEGADGVGNASGNWHCDSTWLGDRVI<br>TTSTRTWALPTYNNHLYKQISNSTSGGSSNDNHYFGYSTP<br>WGYFDFNRFHCHFSPRDWQRLINNNWGFRPKRLNFKLFNI<br>QVKEVTDNNGVKTIANNLTSTVQVFSDSEYQLPYVLGSAH<br>QGCLPPFPADVFMIPQYGYLTLNDGSQAVGRSSFYCLEYF<br>PSQMLRTGNNFTFSYTFEDVPFHSSYAHSQSLDRLMNPLI<br>DQYLYYLNRTIINGSGQNQQTLKFSVAGPSNMAVQPKNWLP<br>GPCYRQQRVSTTVTQNNNSEFAWPGASKYNLNGRESIINP<br>GTAMASHKEGEDRFFPLSGSMIFGKQGTGRDNVDADKVMI<br>TDEEEIKATNPVATERFGTVATNHQSAQAQAQTGWVQNQG<br>ILPGMVWQDRDVYLQGPIWAKIPHTDGHFHPSPLMGGFGL<br>KHPPPQILIKNTPVPANPPAEFSATKFASFITQYSTGQVS<br>VEIEWELQKENSKRWNPEVQYTSNYYKSNNVEFAVNTEGL<br>YTEPRPIGTRYLTRPL |
| AAV6.2_9GH<br>SEQ ID NO: 97 | AAV6.2 | AAV9 | GH | MAADGYLPDWLEDNLSEGIREWWDLKPGAPKPKANQQKQD<br>DGRGLVLPGYKYLGPFNGLDKGEPVNAADAAALEHDKAYD<br>QQLKAGDNPYLRYNHADAEFQERLQEDTSFGGNLGRAVFQ<br>AKKRVLEPLGLVEEGAKTAPGKKRPVEQSPQEPDSSSGIG<br>KTGQQPAKKRLNFGQTGDSESVPDPQPLGEPPATPAAVGP<br>TTMASGGGAPMADNNEGADGVGNASGNWHCDSTWLGDRVI<br>TTSTRTWALPTYNNHLYKQISSASTGASNDNHYFGYSTPW<br>GYFDFNRFHCHFSPRDWQRLINNNWGFRPKRLNFKLFNIQ<br>VKEVTTNDGVTTIANNLTSTVQVFSDSEYQLPYVLGSAHQ<br>GCLPPFPADVFMIPQYGYLTLNNGSQAVGRSSFYCLEYFP<br>SQMLRTGNNFTFSYTFEDVPFHSSYAHSQSLDRLMNPLID<br>QYLYYLSKTINGSGQNQQTLKFSVAGPSNMAVQGRNYIPG<br>PSYRQQRVSTTVTQNNNSEFAWPGASSWALNGRNSLMNPG<br>PAMASHKEGEDRFFPLSGSLIFGKQGTGRDNVDADKVMIT |

TABLE 3-continued

| Name/<br>SEQ ID NO: | Backbone<br>Sequence | Donor<br>Sequence | Substitution | VP1 Amino Acid Sequence |
|---|---|---|---|---|
| | | | | NEEEIKTTNPVATESYGQVATNHQSAQAQAQTGWVQNQGI<br>LPGMVWQDRDVYLQGPIWAKIPHTDGHFHPSPLMGGFGLK<br>HPPPQILIKNTPVPANPPAEFSATKFASFITQYSTGQVSV<br>EIEWELQKENSKRWNPEVQYTSNYAKSANVDFTVDNNGLY<br>TEPRPIGTRYLTRPL |
| AAVmo_2VR<br>SEQ ID NO: 98 | AAVmo | AAV2 | VR | MSFFDWLGKQYAQGAAEFWDLKSGPPAPKKARKDGSAGFN<br>FPGHKYLGPGNSLDRGDPVDADDAAAQKHDQSYQEQLEAG<br>DNPYLKYNHADREFQEALKDDTSFEGNLARGLFEAKKLVA<br>EPLGLVEPELAPPSGRKRPVQSSQESGYSSSQDKRPNLDV<br>DEEDREFAAAAAETETGSAPPTGNLGPGTMAGGGSAPIDD<br>GSYGADGVGNASGDWHCDSTWLDNCVITRTTRTWNLPTYN<br>NHIYKRLSSQSGASNDNHSYFGFSTPWGYFDFNRFHCHFS<br>PRDWQRLINNNWGLRPKSLRFKIFNIQVKEVTQNDGTTTI<br>SNNLTSTVQVFADTEYQLPYVIGSAHEGCLPPFPADVFML<br>PQYGYCTLNNGSQPTPRSAFYCLEYFPSKMLRTGNSFEFT<br>YNFEKVPFHSMWAHNQSLDRLMNPLIDQYLYYLDVTNTPS<br>GTTTQSRFTYQKGVHTNLPEQERNWLPGPGIRNQRVSKTS<br>ADNNNSEYSWQYSNKYVLENGRASKIAPGPAMASHKDDEE<br>KFFPQSGVLIFGKQGSEKTNVDIEKVMITRETEINSTNPL<br>AGGSLGAVSTNLQRGNRQAALDHTNVMGVFPGSVWQDRDI<br>YLQGQIWAKIPHTDGHFHPSPLMGGFGLKNPPPQILIKNT<br>PVPADPPTEFNANKISSFITQYSTGQVTVEMEWELQKETS<br>KRWNPEIQYTSNYNKSVNVHFAPDDVGNYKEFRSIGTRYL<br>TRPL |
| AAVmo_2VRGH<br>SEQ ID NO: 99 | AAVmo | AAV2 | VRGH | MSFFDWLGKQYAQGAAEFWDLKSGPPAPKKARKDGSAGFN<br>FPGHKYLGPGNSLDRGDPVDADDAAAQKHDQSYQEQLEAG<br>DNPYLKYNHADREFQEALKDDTSFEGNLARGLFEAKKLVA<br>EPLGLVEPELAPPSGRKRPVQSSQESGYSSSQDKRPNLDV<br>DEEDREFAAAAAETETGSAPPTGNLGPGTMAGGGSAPIDD<br>GSYGADGVGNASGDWHCDSTWLDNCVITRTTRTWNLPTYN<br>NHIYKRLSSQSGASNDNHSYFGFSTPWGYFDFNRFHCHFS<br>PRDWQRLINNNWGLRPKSLRFKIFNIQVKEVTQNDGTTTI<br>SNNLTSTVQVFADTEYQLPYVIGSAHEGCLPPFPADVFML<br>PQYGYCTLNNGSQPTPRSAFYCLEYFPSKMLRTGNSFEFT<br>YNFEDVPFHSSYAHSQSLDRLMNPLIDQYLYYLSRTNTPS<br>GTTTQSRLQFSQAGASDIRDQSRNWLPGPCYRQQRVSKTS<br>ADNNNSEYSWTGATKYHLNGRDSLVNPGPAMASHWTGATKYHLNGRDSLVNPGPAMASHKDDEEK<br>FFPQSGVLIFGKQGSEKTNVDIEKVMITDEEEIRTTNPVA<br>TEQYGSVSTNLQRGNRQAATADVNTQGVFPGSVWQDRDIY<br>LQGQIWAKIPHTDGHFHPSPLMGGFGLKNPPPQILIKNTP<br>VPADPPTEFNANKISSFITQYSTGQVTVEMEWELQKETSK<br>RWNPEIQYTSNYNKSVNVHFAPDDVGNYKEFRSIGTRYLT<br>RPL |
| AAVmo_9VR<br>SEQ ID NO: 100 | AAVmo | AAV9 | VR | MSFFDWLGKQYAQGAAEFWDLKSGPPAPKKARKDGSAGFN<br>FPGHKYLGPGNSLDRGDPVDADDAAAQKHDQSYQEQLEAG<br>DNPYLKYNHADREFQEALKDDTSFEGNLARGLFEAKKLVA<br>EPLGLVEPELAPPSGRKRPVQSSQESGYSSSQDKRPNLDV<br>DEEDREFAAAAAETETGSAPPTGNLGPGTMAGGGSAPIDD<br>GSYGADGVGNASGDWHCDSTWLDNCVITRTTRTWNLPTYN<br>NHIYKQISNSTSGGSSNDNAYFGFSTPWGYFDFNRFHCHF<br>SPRDWQRLINNNWGLRPKSLRFKIFNIQVKEVTDNNGVKI<br>ISNNLTSTVQVFADTEYQLPYVIGSAHEGCLPPFPADVFM<br>LPQYGYLTLNDGSQAVGRSSFYCLEYFPSKMLRTGNSFEF<br>TYNFEKVPFHSMWAHNQSLDRLMNPLIDQYLYYLSKTING<br>SGQNQQTLKFSVAGPSNMAVQGRNWLPGPGIRQQRVSTTV<br>TQNNNSEFAWPGASSWALNGRASKIAPGPAMASHKEGEDR<br>FFPLSGSLIFGKQGTGRDNVDADKVNITRETEINSTNPLA<br>GGSLGQVATNHQSAQAQAQTGWVQNQGVFPGSVWQDRDIY<br>LQGQIWAKIPHTDGHFHPSPLMGGFGLKNPPPQILIKNTP<br>VPADPPTEFNANKISSFITQYSTGQVTVEMEWELQKETSK<br>RWNPEIQYTSNYYKSNNVEFAVNTEGVYKEFRSIGTRYLT<br>RPL |
| AAVmo_9GH<br>SEQ ID NO: 101 | AAVmo | AAV9 | GH | MSFFDWLGKQYAQGAAEFWDLKSGPPAPKKARKDGSAGFN<br>FPGHKYLGPGNSLDRGDPVDADDAAAQKHDQSYQEQLEAG<br>DNPYLKYNHADREFQEALKDDTSFEGNLARGLFEAKKLVA<br>EPLGLVEPELAPPSGRKRPVQSSQESGYSSSQDKRPNLDV<br>DEEDREFAAAAAETETGSAPPTGNLGPGTMAGGGSAPIDD<br>GSYGADGVGNASGDWHCDSTWLDNCVITRTTRTWNLPTYN<br>NHIYKRLNGTTSGDQSYFGFSTPWGYFDFNRFHCHFSPRD<br>WQRLINNNWGLRPKSLRFKIFNIQVKEVTTQDSTKIISNN<br>LTSTVQVFADTEYQLPYVIGSAHEGCLPPFPADVFMLPQY<br>GYCTRQDGNSNNPTPRSAFYCLEYFPSKMLRTGNSFEFTY<br>NFEKVPFHSMWAHNQSLDRLMNPLIDQYLYYLSKTINGSG |

TABLE 3-continued

| Name/<br>SEQ ID NO: | Backbone<br>Sequence | Donor<br>Sequence | Substitution | VP1 Amino Acid Sequence |
|---|---|---|---|---|
| | | | | QNQQTLKFSVAGPSNMAVQGRNYIPGPSYRQQRVSTTVTQ<br>NNNSEFAWPGASSWALNGRNSLMNPGPAMASHKEGEDRFF<br>PLSGSLIFGKQGTGRDNVDADKVMITNEEEIKTTNPVATE<br>SYGQVATNHQSAQAQAQTGWVQNQGVFPGSVWQDRDIYLQ<br>GQIWAKIPHTDGHFHPSPLMGGFGLKNPPPQILIKNTPVP<br>ADPPTEFNANKISSFITQYSTGQVTEMEWELQKETSKRW<br>NPEIQYSDDSSSTSGSILHFAPDDVGNYKEFRSIGTRYLT<br>RPL |
| AAVmo_9VRGH<br>SEQ ID NO: 102 | AAVmo | AAV9 | VRGH | MSFFDWLGKQYAQGAAEFWDLKSGPPAPKKARKDGSAGFN<br>FPGHKYLGPGNSLDRGDPVDADDAAAQKHDQSYQEQLEAG<br>DNPYLKYNHADREFQEALKDDTSFEGNLARGLFEAKKLVA<br>EPLGLVEPELAPPSGRKRPVQSSQESGYSSSQDKRPNLDV<br>DEEDREFAAAAAETETGSAPPTGNLGPGTMAGGGSAPIDD<br>GSYGADGVGNASGDWHCDSTWLDNCVITRTTRTWNLPTYN<br>NHIYKQISNSTSGGSSNDAYFGFSTPWGYFDFNRFHCHF<br>SPRDWQRLINNNWGLRPKSLRFKIFNIQVKEVTDNNGVKI<br>ISNNLTSTVQVFADTEYQLPYVIGSAHEGCLPPFPADVFM<br>LPQYGYLTLNDGSQAVGRSSFYCLEYFPSKMLRTGNSFEF<br>TYNFEKVPFHSMWAHNQSLDRLMNPLIDQYLYYLSKTING<br>SGQNQQTLKFSVAGPSNMAVQGRNYIPGPSYRQQRVSTTV<br>TQNNNSEFAWPGASSWALNGRNSLMNPGPAMASHKEGEDR<br>FFPLSGSLIFGKQGTGRDNVDADKVMITNEEEIKTTNPVA<br>TESYGQVATNHQSAQAQAQTGWVQNQGVFPGSVWQDRDIY<br>LQGQIWAKIPHTDGHFHPSPLMGGFGLKNPPPQILIKNTP<br>VPADPPTEFNANKISSFITQYSTGQVTEMEWELQKETSK<br>RWNPEIQYTSNYYKSNNVEFAVNTEGVYKEFRSIGTRYLT<br>RPL |
| AAVmo_8VR<br>SEQ ID NO: 103 | AAVmo | AAV8 | VR | MSFFDWLGKQYAQGAAEFWDLKSGPPAPKKARKDGSAGFN<br>FPGHKYLGPGNSLDRGDPVDADDAAAQKHDQSYQEQLEAG<br>DNPYLKYNHADREFQEALKDDTSFEGNLARGLFEAKKLVA<br>EPLGLVEPELAPPSGRKRPVQSSQESGYSSSQDKRPNLDV<br>DEEDREFAAAAAETETGSAPPTGNLGPGTMAGGGSAPIDD<br>GSYGADGVGNASGDWHCDSTWLDNCVITRTTRTWNLPTYN<br>NHIYKQISNGTSGGATNDNTYFGFSTPWGYFDFNRFHCHF<br>SPRDWQRLINNNWGLRPKSLRFKIFNIQVKEVTQNEGTKI<br>ISNNLTSTVQVFADTEYQLPYVIGSAHEGCLPPFPADVFM<br>LPQYGYLTLNNGSQAVGRSSFYCLEYFPSKMLRTGNSFEF<br>TYNFEKVPFHSMWAHNQSLDRLMNPLIDQYLYYLSRTQTT<br>GGTANTQTLGFSQGGPNTMANQAKNWLPGPGIRQQRVSTT<br>TGQNNSNFAWTAGTKYHLNGRASKIAPGPAMATHKDDEE<br>RFFPSNGILIFGKQNAARDNADYSDVNITRETEINSTNPL<br>AGGSLGIVADNLQQQNTAPQIGTVNSQGVFPGSVWQDRDI<br>YLQGQIWAKIPHTDGHFHPSPLMGGFGLKNPPPQILIKNT<br>PVPADPPTEFNANKISSFITQYSTGQVTEMEWELQKETS<br>KRWNPEIQYTSNYYKSTSVDFAVNTEGVYKEFRSIGTRYL<br>TRPL |
| AAVmo_8GH<br>SEQ ID NO: 104 | AAVmo | AAV8 | GH | MSFFDWLGKQYAQGAAEFWDLKSGPPAPKKARKDGSAGFN<br>FPGHKYLGPGNSLDRGDPVDADDAAAQKHDQSYQEQLEAG<br>DNPYLKYNHADREFQEALKDDTSFEGNLARGLFEAKKLVA<br>EPLGLVEPELAPPSGRKRPVQSSQESGYSSSQDKRPNLDV<br>DEEDREFAAAAAETETGSAPPTGNLGPGTMAGGGSAPIDD<br>GSYGADGVGNASGDWHCDSTWLDNCVITRTTRTWNLPTYN<br>NHIYKRLNGTTSGDQSYFGFSTPWGYFDFNRFHCHFSPRD<br>WQRLINNNWGLRPKSLRFKIFNIQVKEVTTQDSTKIISNN<br>LTSTVQVFADTEYQLPYVIGSAHEGCLPPFPADVFMLPQY<br>GYCTRQDGNSNNPTPRSAFYCLEYFPSKMLRTGNSFEFTY<br>NFEKVPFHSMWAHNQSLDRLMNPLIDQYLYYLSRTQTTGG<br>TANTQTLGFSQGGPNTMANQAKNWLPGPCYRQQRVSTTTG<br>QNNNSNFAWTAGTKYHLNGRNSLANPGIAMATHKDDEERF<br>FPSNGILIFGKQNAARDNADYSDVMLTSEEEIKTTNPVAT<br>EEYGIVADNLQQQNTAPQIGTVNSQGVFPGSVWQDRDIYL<br>QGQIWAKIPHTDGHFHPSPLMGGFGLKNPPPQILIKNTPV<br>PADPPTEFNANKISSFITQYSTGQVTEMEWELQKETSKR<br>WNPEIQYSDDSSSTSGSILHFAPDDVGNYKEFRSIGTRYL<br>TRPL |
| AAVmo_8VRGH<br>SEQ ID NO: 105 | AAVmo | AAV8 | VRGH | MSFFDWLGKQYAQGAAEFWDLKSGPPAPKKARKDGSAGFN<br>FPGHKYLGPGNSLDRGDPVDADDAAAQKHDQSYQEQLEAG<br>DNPYLKYNHADREFQEALKDDTSFEGNLARGLFEAKKLVA<br>EPLGLVEPELAPPSGRKRPVQSSQESGYSSSQDKRPNLDV<br>DEEDREFAAAAAETETGSAPPTGNLGPGTMAGGGSAPIDD<br>GSYGADGVGNASGDWHCDSTWLDNCVITRTTRTWNLPTYN<br>NHIYKQISNGTSGGATNDNTYFGFSTPWGYFDFNRFHCHF<br>SPRDWQRLINNNWGLRPKSLRFKIFNIQVKEVTQNEGTKI |

TABLE 3-continued

| Name/<br>SEQ ID NO: | Backbone<br>Sequence | Donor<br>Sequence | Substitution | VP1 Amino Acid Sequence |
|---|---|---|---|---|
| | | | | ISNNLTSTVQVFADTEYQLPYVIGSAHEGCLPPFPADVFM<br>LPQYGYLTLNNGSQAVGRSSFYCLEYFPSKMLRTGNSFEF<br>TYNFEKVPFHSMWAHNQSLDRLMNPLIDQYLYYLSRTQTT<br>GGTANTQTLGFSQGGPNTMANQAKNWLPGPCYRQQRVSTT<br>TGQNNNSNFAWTAGTKYHLNGRNSLANPGIAMATHKDDEE<br>RFFPSNGILIFGKQNAARDNADYSDVMLTSEEEIKTTNPV<br>ATEEYGIVADNLQQQNTAPQIGTVNSQGVFPGSVWQDRDI<br>YLQGQIWAKIPHTDGHFHPSPLMGGFGLKNPPPQILIKNT<br>PVPADPPTEFNANKISSFITQYSTGQVTVEMEWELQKETS<br>KRWNPEIQYTSNYYKSTSVDFAVNTEGVYKEFRSIGTRYL<br>TRPL |
| AAV4_2VR<br>SEQ ID NO: 106 | AAV4 | AAV2 | VR | MTDGYLPDWLEDNLSEGVREWWALQPGAPKPKANQQHQDN<br>ARGLVLPGYKYLGPGNGLDKGEPVNAADAAALEHDKAYDQ<br>QLKAGDNPYLKYNHADAEFQQRLQGDTSFGGNLGRAVFQA<br>KKRVLEPLGLVEQAGETAPGKKRPLIESPQQPDSSTGIGK<br>KGKQPAKKKLVFEDETGAGDGPPEGSTSGAMSDDSEMRAA<br>AGGAAVEGGQGADGVGNASGDWHCDSTWSEGHVTTTSTRT<br>WVLPTYNNHLYKQISSQSGASNDNHYFGFSTPWGYFDFNR<br>FHCHFSPRDWQRLINNNWGMRPKAMRVKIFNIQVKEVTQN<br>DGTTTVANNLTSTVQIFADSSYELPYVMDAGQEGSLPPFP<br>NDVFMVPQYGYLTLNNGSQAVGRSSFYCLEYFPSQMLRTG<br>NNFEITYSFEKVPFHSMYAHSQSLDRLMNPLIDQYLYYLS<br>RTNTPSGTTTQSRLQFSQAGASDIRDQSRNWLPGPSIRQQ<br>RVSKTSADNNNSEYSWTGATKYHLNGRWSALTPGPPMATH<br>KDDEEKFFPQSGVLIFGKQGSEKTNVDIEKLIFTSEEELA<br>ATNATDTDMWGSVSTNLQRGNRQAATADVNTQGAVPGMVW<br>QNRDIYYQGPIWAKIPHTDGHFHPSPLIGGFGLKHPPPQI<br>FIKNTPVPANPATTFSSTPVNSFITQYSTGQVSVQIDWEI<br>QKERSKRWNPEVQFTSNYNKSVNVDFTVDTNGVYTEPRAI<br>GTRYLTHHL |
| AAV4_2GH<br>SEQ ID NO: 107 | AAV4 | AAV2 | GH | MTDGYLPDWLEDNLSEGVREWWALQPGAPKPKANQQHQDN<br>ARGLVLPGYKYLGPGNGLDKGEPVNAADAAALEHDKAYDQ<br>QLKAGDNPYLKYNHADAEFQQRLQGDTSFGGNLGRAVFQA<br>KKRVLEPLGLVEQAGETAPGKKRPLIESPQQPDSSTGIGK<br>KGKQPAKKKLVFEDETGAGDGPPEGSTSGAMSDDSEMRAA<br>AGGAAVEGGQGADGVGNASGDWHCDSTWSEGHVTTTSTRT<br>WVLPTYNNHLYKRLGESLQSNTYNGFSTPWGYFDFNRFHC<br>HFSPRDWQRLINNNWGMRPKAMRVKIFNIQVKEVTTSNGE<br>TTVANNLTSTVQIFADSSYELPYVMDAGQEGSLPPFPNDV<br>FMVPQYGYCGLVTGNTSQQQTDRNAFYCLEYFPSQMLRTG<br>NNFEITYSFEKVPFHSMYAHSQSLDRLMNPLIDQYLYYLS<br>RTNTPSGTTTQSRLQFSQAGASDIRDQSRNWLPGPCYRQQ<br>RVSKTSADNNNSEYSWTGATKYHLNGRDSLVNPGPAMASH<br>KDDEEKFFPQSGVLIFGKQGSEKTNVDIEKVMITDEEEIR<br>TTNPVATEQYGSVSTNLQRGNRQAATADVNTQGAVPGMVW<br>QNRDIYYQGPIWAKIPHTDGHFHPSPLIGGFGLKHPPPQI<br>FIKNTPVPANPATTFSSTPVNSFITQYSTGQVSVQIDWEI<br>QKERSKRWNPEVQFTSNYGQQNSLLWAPDAAGKYTEPRAI<br>GTRYLTHHL |
| AAV4_2VRGH<br>SEQ ID NO: 108 | AAV4 | AAV2 | VRGH | MTDGYLPDWLEDNLSEGVREWWALQPGAPKPKANQQHQDN<br>ARGLVLPGYKYLGPGNGLDKGEPVNAADAAALEHDKAYDQ<br>QLKAGDNPYLKYNHADAEFQQRLQGDTSFGGNLGRAVFQA<br>KKRVLEPLGLVEQAGETAPGKKRPLIESPQQPDSSTGIGK<br>KGKQPAKKKLVFEDETGAGDGPPEGSTSGAMSDDSEMRAA<br>AGGAAVEGGQGADGVGNASGDWHCDSTWSEGHVTTTSTRT<br>WVLPTYNNHLYKQISSQSGASNDNHYFGFSTPWGYFDFNR<br>FHCHFSPRDWQRLINNNWGMRPKAMRVKIFNIQVKEVTQN<br>DGTTTVANNLTSTVQIFADSSYELPYVMDAGQEGSLPPFP<br>NDVFMVPQYGYLTLNNGSQAVGRSSFYCLEYFPSQMLRTG<br>NNFEITYSFEKVPFHSMYAHSQSLDRLMNPLIDQYLYYLS<br>RTNTPSGTTTQSRLQFSQAGASDIRDQSRNWLPGPCYRQQ<br>RVSKTSADNNNSEYSWTGATKYHLNGRDSLVNPGPAMASH<br>KDDEEKFFPQSGVLIFGKQGSEKTNVDIEKVMITDEEEIR<br>TTNPVATEQYGSVSTNLQRGNRQAATADVNTQGAVPGMVW<br>QNRDIYYQGPIWAKIPHTDGHFHPSPLIGGFGLKHPPPQI<br>FIKNTPVPANPATTFSSTPVNSFITQYSTGQVSVQIDWEI<br>QKERSKRWNPEVQFTSNYNKSVNVDFTVDTNGVYTEPRAI<br>GTRYLTHHL |
| AAV4_8VR<br>SEQ ID NO: 109 | AAV4 | AAV8 | VR | MTDGYLPDWLEDNLSEGVREWWALQPGAPKPKANQQHQDN<br>ARGLVLPGYKYLGPGNGLDKGEPVNAADAAALEHDKAYDQ<br>QLKAGDNPYLKYNHADAEFQQRLQGDTSFGGNLGRAVFQA<br>KKRVLEPLGLVEQAGETAPGKKRPLIESPQQPDSSTGIGK<br>KGKQPAKKKLVFEDETGAGDGPPEGSTSGAMSDDSEMRAA |

TABLE 3-continued

| Name/<br>SEQ ID NO: | Backbone<br>Sequence | Donor<br>Sequence | Substitution | VP1 Amino Acid Sequence |
|---|---|---|---|---|
| | | | | AGGAAVEGGQGADVGNASGDWHCDSTWSEGHVTTTSTRT<br>WVLPTYNNHLYKQISNGTSGGATNDNTYFGFSTPWGYFDF<br>NRFHCHFSPRDWQRLINNNWGMRPKAMRVKIFNIQVKEVT<br>QNEGTKTVANNLTSTVQIFADSSYELPYVMDAGQEGSLPP<br>FPNDVFMVPQYGYLTLNNGSQAVGRSSFYCLEYFPSQMLR<br>TGNNFEITYSFEKVPFHSMYAHSQSLDRLMNPLIDQYLYY<br>LSRTQTTGGTANTQTLGFSQGGPNTMANQAKNWLPGPSIR<br>QQRVSTTTGQNNNSNFAWTAGTKYHLNGRWSALTPGPPMA<br>THKDDEERFFPSNGILIFGKQNAARDNADYSDLIFTSEEE<br>LAATNATDTDMWGIVADNLQQQNTAPQIGTVNSQGAVPGM<br>VWQNRDIYYQGPIWAKIPHTDGHFHPSPLIGGFGLKHPPP<br>QIFIKNTPVPANPATTFSSTPVNSFITQYSTGQVSVQIDW<br>EIQKERSKRWNPEVQFTSNYYKSTSVDFAVNTEGVYTEPR<br>AIGTRYLTHHL |
| AAV4_8GH<br>SEQ ID NO: 110 | AAV4 | AAV8 | GH | MTDGYLPDWLEDNLSEGVREWWALQPGAPKPKANQQHQDN<br>ARGLVLPGYKYLGPGNGLDKGEPVNAADAAALEHDKAYDQ<br>QLKAGDNPYLKYNHADAEFQQRLQGDTSFGGNLGRAVFQA<br>KKRVLEPLGLVEQAGETAPGKKRPLIESPQQPDSSTGIGK<br>KGKQPAKKKLVFEDETGAGDGPPEGSTSGAMSDDSEMRAA<br>AGGAAVEGGQGADVGNASGDWHCDSTWSEGHVTTTSTRT<br>WVLPTYNNHLYKRLGESLQSNTYNGFSTPWGYFDFNRFHC<br>HFSPRDWQRLINNNWGMRPKAMRVKIFNIQVKEVTTSNGE<br>TTVANNLTSTVQIFADSSYELPYVMDAGQEGSLPPFPNDV<br>FMVPQYGYCGLVTGNTSQQQTDRNAFYCLEYFPSQMLRTG<br>NNFEITYSFEKVPFHSMYAHSQSLDRLMNPLIDQYLYYLS<br>RTQTTGGTANTQTLGFSQGGPNTMANQAKNWLPGPCYRQQ<br>RVSTTTGQNNNSNFAWTAGTKYHLNGRNSLANPGIAMATH<br>KDDEERFFPSNGILIFGKQNAARDNADYSDVMLTSEEEIK<br>TTNPVATEEYGIVADNLQQQNTAPQIGTVNSQGAVPGMVW<br>QNRDIYYQGPIWAKIPHTDGHFHPSPLIGGFGLKHPPPQI<br>FIKNTPVPANPATTFSSTPVNSFITQYSTGQVSVQIDWEI<br>QKERSKRWNPEVQFTSNYGQQNSLLWAPDAAGKYTEPRAI<br>GTRYLTHHL |
| AAV4_8VRGH<br>SEQ ID NO: 111 | AAV4 | AAV8 | VRGH | MTDGYLPDWLEDNLSEGVREWWALQPGAPKPKANQQHQDN<br>ARGLVLPGYKYLGPGNGLDKGEPVNAADAAALEHDKAYDQ<br>QLKAGDNPYLKYNHADAEFQQRLQGDTSFGGNLGRAVFQA<br>KKRVLEPLGLVEQAGETAPGKKRPLIESPQQPDSSTGIGK<br>KGKQPAKKKLVFEDETGAGDGPPEGSTSGAMSDDSEMRAA<br>AGGAAVEGGQGADVGNASGDWHCDSTWSEGHVTTTSTRT<br>WVLPTYNNHLYKQISNGTSGGATNDNTYFGFSTPWGYFDF<br>NRFHCHFSPRDWQRLINNNWGMRPKAMRVKIFNIQVKEVT<br>QNEGTKTVANNLTSTVQIFADSSYELPYVMDAGQEGSLPP<br>FPNDVFMVPQYGYLTLNNGSQAVGRSSFYCLEYFPSQMLR<br>TGNNFEITYSFEKVPFHSMYAHSQSLDRLMNPLIDQYLYY<br>LSRTQTTGGTANTQTLGFSQGGPNTMANQAKNWLPGPCYR<br>QQRVSTTTGQNNNSNFAWTAGTKYHLNGRNSLANPGIAMA<br>THKDDEERFFPSNGILIFGKQNAARDNADYSDVMLTSEEE<br>IKTTNPVATEEYGIVADNLQQQNTAPQIGTVNSQGAVPGM<br>VWQNRDIYYQGPIWAKIPHTDGHFHPSPLIGGFGLKHPPP<br>QIFIKNTPVPANPATTFSSTPVNSFITQYSTGQVSVQIDW<br>EIQKERSKRWNPEVQFTSNYYKSTSVDFAVNTEGVYTEPR<br>AIGTRYLTHHL |
| AAV4_9VR<br>SEQ ID NO: 112 | AAV4 | AAV9 | VR | MTDGYLPDWLEDNLSEGVREWWALQPGAPKPKANQQHQDN<br>ARGLVLPGYKYLGPGNGLDKGEPVNAADAAALEHDKAYDQ<br>QLKAGDNPYLKYNHADAEFQQRLQGDTSFGGNLGRAVFQA<br>KKRVLEPLGLVEQAGETAPGKKRPLIESPQQPDSSTGIGK<br>KGKQPAKKKLVFEDETGAGDGPPEGSTSGAMSDDSEMRAA<br>AGGAAVEGGQGADVGNASGDWHCDSTWSEGHVTTTSTRT<br>WVLPTYNNHLYKQISNSTSGGSSNDNAYFGFSTPWGYFDF<br>NRFHCHFSPRDWQRLINNNWGMRPKAMRVKIFNIQVKEVT<br>DNNGVKTVANNLTSTVQIFADSSYELPYVMDAGQEGSLPP<br>FPNDVFMVPQYGYLTLNDGSQAVGRSSFYCLEYFPSQMLR<br>TGNNFEITYSFEKVPFHSMYAHSQSLDRLMNPLIDQYLYY<br>LSKTINGSGQNQQTLKFSVAGPSNMAVQGRNWLPGPSIRQ<br>QRVSTTVTQNNNSEFAWPGASSWALNGRWSALTPGPPMAT<br>HKEGEDRFFPLSGSLIFGKQGTGRDNVDADKLIFTSEEEL<br>AATNATDTDMWGQVATNHQSAQAQTGWVNQGAVPGMV<br>WQNRDIYYQGPIWAKIPHTDGHFHPSPLIGGFGLKHPPPQ<br>IFIKNTPVPANPATTFSSTPVNSFITQYSTGQVSVQIDWE<br>IQKERSKRWNPEVQFTSNYYKSTSVDFAVNTEGVYTEPRA<br>IGTRYLTHHL |

TABLE 3-continued

| Name/ SEQ ID NO: | Backbone Sequence | Donor Sequence | Substitution | VP1 Amino Acid Sequence |
|---|---|---|---|---|
| AAV4_9GH SEQ ID NO: 113 | AAV4 | AAV9 | GH | MTDGYLPDWLEDNLSEGVREWWALQPGAPKPKANQQHQDN ARGLVLPGYKYLGPGNGLDKGEPVNAADAAALEHDKAYDQ QLKAGDNPYLKYNHADAEFQQRLQGDTSFGGNLGRAVFQA KKRVLEPLGLVEQAGETAPGKKRPLIESPQQPDSSTGIGK KGKQPAKKKLVFEDETGAGDGPPEGSTSGAMSDDSEMRAA AGGAAVEGGQGADGVGNASGDWHCDSTWSEGHVTTTSTRT WVLPTYNNHLYKRLGESLQSNTYNGFSTPWGYFDFNRFHC HFSPRDWQRLINNNWGMRPKAMRVKIFNIQVKEVTTSNGE TTVANNLTSTVQIFADSSYELPYVMDAGQEGSLPPFPNDV FMVPQYGYCGLVTGNTSQQQTDRNAFYCLEYFPSQMLRTG NNFEITYSFEKVPFHSMYAHSQSLDRLMNPLIDQYLYYLS KTINGSGQNQQTLKFSVAGPSNMAVQGRNYIPGPSYRQQR VSTTVTQNNNSEFAWPGASSWALNGRNSLMNPGPAMASHK EGEDRFFPLSGSLIFGKQGTGRDNVDADKVMITNEEEIKT TNPVATESYGQVATNHQSAQAQAQTGWVQNQGAVPGMVWQ NRDIYYQGPIWAKIPHTDGHFHPSPLIGGFGLKHPPPQIF IKNTPVPANPATTFSSTPVNSFITQYSTGQVSVQIDWEIQ KERSKRWNPEVQFTSNYGQQNSLLWAPDAAGKYTEPRAIG TRYLTHHL |
| AAV4_9VRGH SEQ ID NO: 114 | AAV4 | AAV9 | VRGH | MTDGYLPDWLEDNLSEGVREWWALQPGAPKPKANQQHQDN ARGLVLPGYKYLGPGNGLDKGEPVNAADAAALEHDKAYDQ QLKAGDNPYLKYNHADAEFQQRLQGDTSFGGNLGRAVFQA KKRVLEPLGLVEQAGETAPGKKRPLIESPQQPDSSTGIGK KGKQPAKKKLVFEDETGAGDGPPEGSTSGAMSDDSEMRAA AGGAAVEGGQGADGVGNASGDWHCDSTWSEGHVTTTSTRT WVLPTYNNHLYKQISNSTSGGSSNDNAYFGFSTPWGYFDF NRFHCHFSPRDWQRLINNNWGMRPKAMRVKIFNIQVKEVT DNNGVKTVANNLTSTVQIFADSSYELPYVMDAGQEGSLPP FPNDVFMVPQYGYLTLNDGSQAVGRSSFYCLEYFPSQMLR TGNNFEITYSFEKVPFHSMYAHSQSLDRLMNPLIDQYLYY LSKTINGSGQNQQTLKFSVAGPSNMAVQGRNYIPGPSYRQ QRVSTTVTQNNNSEFAWPGASSWALNGRNSLMNPGPAMAS HKEGEDRFFPLSGSLIFGKQGTGRDNVDADKVMITNEEEI KTTNPVATESYGQVATNHQSAQAQAQTGWVQNQGAVPGMV WQNRDIYYQGPIWAKIPHTDGHFHPSPLIGGFGLKHPPPQ IFIKNTPVPANPATTFSSTPVNSFITQYSTGQVSVQIDWE IQKERSKRWNPEVQFTSNYYKSNNVEFAVNTEGVYTEPRA IGTRYLTHHL |
| AAVbo_9VR SEQ ID NO: 115 | AAVbo | AAV9 | VR | MSFVDHPPDWLESIGDGFREFLGLEAGPPKPKANQQKQDN ARGLVLPGYKYLGPGNGLDKGDPVNFADEVAREHDLSYQK QLEAGDNPYLKYNHADAEFQEKLASDTSFGGNLGKAVFQA KKRILEPLGLVETPDKTAPAAKKRPLEQSPQEPDSSSGVG KKGKQPARKRLNFDDEPGAGDGPPPEGPSSGAMSTETEMR AAAGGNGGDAGQGAEGVGNASGDWHCDSTWSESHVTTTST RTWVLPTYNNHLYLQISNSTSGGSSNDNAYFGFSTPWGYF DFNRFHCHFSPRDWQRLINNHWGLRPKSMQVRIFNIQVKE VTDNNGVKSNNLTSTVQIFADSTYELPYVMDAGQEGSLPP FPNDVFMVPQYGYLTLNDGSQAVGRSSFYCLEYFPSQMLR TGNNFEMVYKFENVPFHSMYAHSQSLDRLMNPLLDQYLYY LSKTINGSGQNQQTLKFSVAGPSNMAVQGRNWLPGMMRQ QRVSTTVTQNNNSEFAWPGASSWALNGRWSNFAPGTAMAT HKEGEDRFFPLSGSLIFGKQGTGRDNVDADKLMFTSEDEL RATNPRDTDLFGQVATNHQSAQAQAQTGWVQNQGVYPGMV WQDRDIYYQGPIWAKIPHTDGHFHPSPLIGGFGLKSPPPQ IFIKNTPVPANPATTFSPARINSFITQYSTGQVAVKIEWE IQKERSKRWNPEVQFTSNYYKSNNVEFAVNTEGVYKEPRA IGSRYLTNHL |
| AAVbo_9GH SEQ ID NO: 116 | AAVbo | AAV9 | GH | MSFVDHPPDWLESIGDGFREFLGLEAGPPKPKANQQKQDN ARGLVLPGYKYLGPGNGLDKGDPVNFADEVAREHDLSYQK QLEAGDNPYLKYNHADAEFQEKLASDTSFGGNLGKAVFQA KKRILEPLGLVETPDKTAPAAKKRPLEQSPQEPDSSSGVG KKGKQPARKRLNFDDEPGAGDGPPPEGPSSGAMSTETEMR AAAGGNGGDAGQGAEGVGNASGDWHCDSTWSESHVTTTST RTWVLPTYNNHLYLRLGSSNASDTFNGFSTPWGYFDFNR HCHFSPRDWQRLINNHWGLRPKSMQVRIFNIQVKEVTTSN GETTVSNNLTSTVQIFADSTYELPYVMDAGQEGSLPPFPN DVFMVPQYGYCGLVTGGSSQNQTDRNAFYCLEYFPSQMLR TGNNFEMVYKFENVPFHSMYAHSQSLDRLMNPLLDQYLYY LSKTINGSGQNQQTLKFSVAGPSNMAVQGRNYIPGPSYRQ QRVSTTVTQNNNSEFAWPGASSWALNGRNSLMNPGPAMAS HKEGEDRFFPLSGSLIFGKQGTGRDNVDADKVMITNEEEI KTTNPVATESYGQVATNHQSAQAQAQTGWVQNQGVYPGMV WQDRDIYYQGPIWAKIPHTDGHFHPSPLIGGFGLKSPPPQ |

TABLE 3-continued

| Name/<br>SEQ ID NO: | Backbone<br>Sequence | Donor<br>Sequence | Substitution | VP1 Amino Acid Sequence |
|---|---|---|---|---|
| | | | | IFIKNTPVPANPATTFSPARINSFITQYSTGQVAVKIEWE<br>IQKERSKRWNPEVQFTSNYGAQDSLLWAPDNAGAYKEPRA<br>IGSRYLTNHL |
| AAVbo_9VRGH<br>SEQ ID NO: 117 | AAVbo | AAV9 | VRGH | MSFVDHPPDWLESIGDGFREFLGLEAGPPKPKANQQKQDN<br>ARGLVLPGYKYLGPGNGLDKGDPVNFADEVAREHDLSYQK<br>QLEAGDNPYLKYNHADAEFQEKLASDTSFGGNLGKAVFQA<br>KKRILEPLGLVETPDKTAPAAKKRPLEQSPQEPDSSSGVG<br>KKGKQPARKRLNFDDEPGAGDGPPPEGPSSGAMSTETEMR<br>AAAGGNGGDAGQGAEGVGNASGDWHCDSTWSESHVTTTST<br>RTWVLPTYNNHLYLQISNSTGGGSSNDNAYFGFSTPWGYF<br>DFNRFHCHFSPRDWQRLINNHWGLRPKSMQVRIFNIQVKE<br>VTDNNGVKSNNLTSTVQIFADSTYELPYVMDAGQEGSLPP<br>FPNDVFMVPQYGYLTLNDGSQAVGRSSFYCLEYFPSQMLR<br>TGNNFEMVYKFENVPFHSMYAHSQSLDRLMNPLLDQYLYY<br>LSKTINGSGQNQQTLKFSVAGPSNMAVQGRNYIPGPSYRQ<br>QRVSTTVTQNNNSEFAWPGASSWALNGRNSLMNPGPAMAS<br>HKEGEDRFFPLSGSLIFGKQGTGRDNVDADKVMITNEEEI<br>KTTNPVATESYGQVATNHQSAQAQAQTGWVQNQGVYPGMV<br>WQDRDIYYQGPIWAKIPHTDGHFHPSPLIGGFGLKSPPPQ<br>IFIKNTPVPANPATTFSPARINSFITQYSTGQVAVKIEWE<br>IQKERSKRWNPEVQFTSNYYKSNNVEFAVNTEGVYKEPRA<br>IGSRYLTNHL |
| AAVbo_8VR<br>SEQ ID NO: 118 | AAVbo | AAV8 | VR | MSFVDHPPDWLESIGDGFREFLGLEAGPPKPKANQQKQDN<br>ARGLVLPGYKYLGPGNGLDKGDPVNFADEVAREHDLSYQK<br>QLEAGDNPYLKYNHADAEFQEKLASDTSFGGNLGKAVFQA<br>KKRILEPLGLVETPDKTAPAAKKRPLEQSPQEPDSSSGVG<br>KKGKQPARKRLNFDDEPGAGDGPPPEGPSSGAMSTETEMR<br>AAAGGNGGDAGQGAEGVGNASGDWHCDSTWSESHVTTTST<br>RTWVLPTYNNHLYLQISNGTSGGATNDNTYFGFSTPWGYF<br>DFNRFHCHFSPRDWQRLINNHWGLRPKSMQVRIFNIQVKE<br>VTQNEGTKSNNLTSTVQIFADSTYELPYVMDAGQEGSLPP<br>FPNDVFMVPQYGYLTLNNGSQAVGRSSFYCLEYFPSQMLR<br>TGNNFEMVYKFENVPFHSMYAHSQSLDRLMNPLLDQYLYY<br>LSRTQTTGGTANTQTLGFSQGGPNTMANQAKNWLPGPMMR<br>QQRVSTTTGQNNNSNFAWTAGTKYHLNGRWSNFAPGTAMA<br>THKDDEERFFPSNGILIFGKQNAARDNADYSDLMFTSEDE<br>LRATNPRDTDLFGIVADNLQQQNTAPQIGTVNSQGVYPGM<br>VWQDRDIYYQGPIWAKIPHTDGHFHPSPLIGGFGLKSPPP<br>QIFIKNTPVPANPATTFSPARINSFITQYSTGQVAVKIEW<br>EIQKERSKRWNPEVQFTSNYYKSTSVDFAVNTEGVYKEPR<br>AIGSRYLTNHL |
| AAVbo_8GH<br>SEQ ID NO: 119 | AAVbo | AAV8 | GH | MSFVDHPPDWLESIGDGFREFLGLEAGPPKPKANQQKQDN<br>ARGLVLPGYKYLGPGNGLDKGDPVNFADEVAREHDLSYQK<br>QLEAGDNPYLKYNHADAEFQEKLASDTSFGGNLGKAVFQA<br>KKRILEPLGLVETPDKTAPAAKKRPLEQSPQEPDSSSGVG<br>KKGKQPARKRLNFDDEPGAGDGPPPEGPSSGAMSTETEMR<br>AAAGGNGGDAGQGAEGVGNASGDWHCDSTWSESHVTTTST<br>RTWVLPTYNNHLYLRLGSSNASDTFNGFSTPWGYFDFNRF<br>HCHFSPRDWQRLINNHWGLRPKSMQVRIFNIQVKEVTTSN<br>GETTVSNNLTSTVQIFADSTYELPYVMDAGQEGSLPPFPN<br>DVFMVPQYGYCGLVTGGSSQNQTDRNAFYCLEYFPSQMLR<br>TGNNFEMVYKFENVPFHSMYAHSQSLDRLMNPLLDQYLYY<br>LSRTQTTGGTANTQTLGFSQGGPNTMANQAKNWLPGPCYR<br>QQRVSTTTGQNNNSNFAWTAGTKYHLNGRNSLANPGIAMA<br>THKDDEERFFPSNGILIFGKQNAARDNADYSDVMLTSEEE<br>IKTTNPVATEEYGIVADNLQQQNTAPQIGTVNSQGVYPGM<br>VWQDRDIYYQGPIWAKIPHTDGHFHPSPLIGGFGLKSPPP<br>QIFIKNTPVPANPATTFSPARINSFITQYSTGQVAVKIEW<br>EIQKERSKRWNPEVQFTSNYGAQDSLLWAPDNAGAYKEPR<br>AIGSRYLTNHL |
| AAVbo_8VRGH<br>SEQ ID NO: 120 | AAVbo | AAV8 | VRGH | MSFVDHPPDWLESIGDGFREFLGLEAGPPKPKANQQKQDN<br>ARGLVLPGYKYLGPGNGLDKGDPVNFADEVAREHDLSYQK<br>QLEAGDNPYLKYNHADAEFQEKLASDTSFGGNLGKAVFQA<br>KKRILEPLGLVETPDKTAPAAKKRPLEQSPQEPDSSSGVG<br>KKGKQPARKRLNFDDEPGAGDGPPPEGPSSGAMSTETEMR<br>AAAGGNGGDAGQGAEGVGNASGDWHCDSTWSESHVTTTST<br>RTWVLPTYNNHLYLQISNGTSGGATNDNTYFGFSTPWGYF<br>DFNRFHCHFSPRDWQRLINNHWGLRPKSMQVRIFNIQVKE<br>VTQNEGTKSNNLTSTVQIFADSTYELPYVMDAGQEGSLPP<br>FPNDVFMVPQYGYLTLNNGSQAVGRSSFYCLEYFPSQMLR<br>TGNNFEMVYKFENVPFHSMYAHSQSLDRLMNPLLDQYLYY<br>LSRTQTTGGTANTQTLGFSQGGPNTMANQAKNWLPGPCYR<br>QQRVSTTTGQNNNSNFAWTAGTKYHLNGRNSLANPGIAMA |

TABLE 3-continued

| Name/<br>SEQ ID NO: | Backbone Sequence | Donor Sequence | Substitution | VP1 Amino Acid Sequence |
|---|---|---|---|---|
| | | | | THKDDEERFFPSNGILIFGKQNAARDNADYSDVMLTSEEE
IKTTNPVATEEYGIVADNLQQQNTAPQIGTVNSQGVYPGM
VWQDRDIYYQGPIWAKIPHTDGHFHPSPLIGGFGLKSPPP
QIFIKNTPVPANPATTFSPARINSFITQYSTGQVAVKIEW
EIQKERSKRWNPEVQFTSNYYKSTSVDFAVNTEGVYKEPR
AIGSRYLTNHL |
| AAV8_9VRGBS
SEQ ID NO: 121 | AAV8 | AAV9 | VRGBS | MAADGYLPDWLEDNLSEGIREWWALKPGAPKPKANQQKQD
DGRGLVLPGYKYLGPFNGLDKGEPVNAADAAALEHDKAYD
QQLQAGDNPYLRYNHADAEFQERLQEDTSFGGNLGRAVFQ
AKKRVLEPLGLVEEGAKTAPGKKRPVEPSPQRSPDSSTGI
GKKGQQPARKRLNFGQTGDSESVPDPQPLGEPPAAPSGVG
PNTMAAGGGAPMADNNEGADGVGSSSGNWHCDSTWLGDRV
ITTSTRTWALPTYNNHLYKQISNSTSGGSSNDNTYFGYST
PWGYFDFNRFHCHFSPRDWQRLINNNWGFRPKRLSFKLFN
IQVKEVTDNNGVKTIANNLTSTIQVFTDSEYQLPYVLGSA
HQGCLPPFPADVFMIPQYGYLTLNDGSQAVGRSSFYCLEY
FPSQMLRTGNNFQFTYTFEDVPFHSSYAHSQSLDRLMNPL
IDQYLYYLSRTINGSGQNQQTLGFSVAGPSNMAVQGRNWL
PGPCYRQQRVSTTVTQNNNSEFAWPGGTKYHLNGRNSLAN
PGIAMATHKEGEDRFFPLSGILIFGKQGTGRDNVDADKVM
LTSEEEIKTTNPVATEEYGIVATNHQSAQAQAQTGTVNSQ
GALPGMVWQNRDVYLQGPIWAKIPHTDGNFHPSPLMGGFG
LKHPPPQILIKNTPVPADPPTTFNQSKLNSFITQYSTGQV
SVEIEWELQKENSKRWNPEIQYTSNYYKSNNVEFAVNTEG
VYSEPRPIGTRYLTRNL |
| AAV8_9VRGH
SEQ ID NO: 122 | AAV8 | AAV9 | VRGH | MAADGYLPDWLEDNLSEGIREWWALKPGAPKPKANQQKQD
DGRGLVLPGYKYLGPFNGLDKGEPVNAADAAALEHDKAYD
QQLQAGDNPYLRYNHADAEFQERLQEDTSFGGNLGRAVFQ
AKKRVLEPLGLVEEGAKTAPGKKRPVEPSPQRSPDSSTGI
GKKGQQPARKRLNFGQTGDSESVPDPQPLGEPPAAPSGVG
PNTMAAGGGAPMADNNEGADGVGSSSGNWHCDSTWLGDRV
ITTSTRTWALPTYNNHLYKQISNSTSGGSSNDNTYFGYST
PWGYFDFNRFHCHFSPRDWQRLINNNWGFRPKRLSFKLFN
IQVKEVTDNNGVKTIANNLTSTIQVFTDSEYQLPYVLGSA
HQGCLPPFPADVFMIPQYGYLTLNDGSQAVGRSSFYCLEY
FPSQMLRTGNNFQFTYTFEDVPFHSSYAHSQSLDRLMNPL
IDQYLYYLSKTINGSGQNQQTLKFSVAGPSNMAVQGRNYI
PGPSYRQQRVSTTVTQNNNSEFAWPGASSWALNGRNSLMN
PGPAMASHKEGEDRFFPLSGSLIFGKQGTGRDNVDADKVM
ITNEEEIKTTNPVATESYGQVATNHQSAQAQAQTGWVQNQ
GILPGMVWQNRDVYLQGPIWAKIPHTDGNFHPSPLMGGFG
LKHPPPQILIKNTPVPADPPTTFNQSKLNSFITQYSTGQV
SVEIEWELQKENSKRWNPEIQYTSNYYKSNNVEFAVNTEG
VYSEPRPIGTRYLTRNL |
| AAVanc.110_9VR.PHP
SEQ ID NO: 123 | AAVanc.110 | AAV9 | VR.PHP | MAADGYLPDWLEDNLSEGIREWWDLKPGAPKPKANQQKQD
DGRGLVLPGYKYLGPFNGLDKGEPVNAADAAALEHDKAYD
QQLKAGDNPYLRYNHADAEFQERLQEDTSFGGNLGRAVFQ
AKKRVLEPLGLVEEGAKTAPGKKRPVEQSPQEPDSSSGIG
KTGQQPAKKRLNFGQTGDSESVPDPQPLGEPPAAPSGVGS
NTMASGGGAPMADNNEGADGVGNSSGNWHCDSTWLGDRVI
TTSTRTWALPTYNNHLYKQISNSTSGGSSNDNTYFGYSTP
WGYFDFNRFHCHFSPRDWQRLINNNWGFRPKRLNFKLFNI
QVKEVTDNNGVKTIANNLTSTVQVFTDSEYQLPYVLGSAH
QGCLPPFPADVFMIPQYGYLTLNDGSQAVGRSSFYCLEYF
PSQMLRTGNNFQFSYTFEDVPFHSSYAHSQSLDRLMNPLI
DQYLYFLSRTINGSGQNQQTLQFSQAGPSSMANQARNWVP
GPCYRQQRVSTTVTQNNNSEFAWPGATKYHLNGRDSLMNP
GVAMASHKEGEDRFFPLSGVLIFGKQGTGRDNVDADKVMI
TNEEEIKTTNPVATEEYGAVATNHQSAQTLAVPFKAQAQT
GLVHNQGVLPGMVWQNRDVYLQGPIWAKIPHTDGNFHPSP
LMGGFGLKHPPPQILIKNTPVPADPPTTFNQAKLNSFITQ
YSTGQVSVEIEWELQKENSKRWNPEIQYTSNYYKSNNVEF
AVNTEGVYSEPRPIGTRFLTRNL |
| AAVanc.110_9VR
SEQ ID NO: 124 | AAVanc.110 | AAV9 | VR | MAADGYLPDWLEDNLSEGIREWWDLKPGAPKPKANQQKQD
DGRGLVLPGYKYLGPFNGLDKGEPVNAADAAALEHDKAYD
QQLKAGDNPYLRYNHADAEFQERLQEDTSFGGNLGRAVFQ
AKKRVLEPLGLVEEGAKTAPGKKRPVEQSPQEPDSSSGIG
KTGQQPAKKRLNFGQTGDSESVPDPQPLGEPPAAPSGVGS
NTMASGGGAPMADNNEGADGVGNSSGNWHCDSTWLGDRVI
TTSTRTWALPTYNNHLYKQISNSTSGGSSNDNTYFGYSTP
WGYFDFNRFHCHFSPRDWQRLINNNWGFRPKRLNFKLFNI
QVKEVTDNNGVKTIANNLTSTVQVFTDSEYQLPYVLGSAH
QGCLPPFPADVFMIPQYGYLTLNDGSQAVGRSSFYCLEYF |

TABLE 3-continued

| Name/<br>SEQ ID NO: | Backbone<br>Sequence | Donor<br>Sequence | Substitution | VP1 Amino Acid Sequence |
|---|---|---|---|---|
| | | | | PSQMLRTGNNFQSYTFEDVPFHSSYAHSQSLDRLMNPLI<br>DQYLYFLSRTINGSGQNQQTLQFSQAGPSSMANQARNWVP<br>GPCYRQQRVSTTVTQNNNSEFAWPGATKYHLNGRDSLMNP<br>GVAMASHKEGEDRFFPLSGVLIFGKQGTGRDNVDADKVMI<br>TNEEEIKTTNPVATEEYGAVATNHQSAQAQAQTGLVHNQG<br>VLPGMVWQNRDVYLQGPIWAKIPHTDGNFHPSPLMGGFGL<br>KHPPPQILIKNTPVPADPPTTFNQAKLNSFITQYSTGQVS<br>VEIEWELQKENSKRWNPEIQYTSNYYKSNNVEFAVNTEGV<br>YSEPRPIGTRFLTRNL |
| AAVanc.110_9GH.PHP<br>SEQ ID NO: 125 | AAVanc.110 | AAV9 | GH.PHP | MAADGYLPDWLEDNLSEGIREWWDLKGAPKPKANQQKQD<br>DGRGLVLPGYKYLGPFNGLDKGEPVNAADAAALEHDKAYD<br>QQLKAGDNPYLRYNHADAEFQERLQEDTSFGGNLGRAVFQ<br>AKKRVLEPLGLVEEGAKTAPGKKRPVEQSPQEPDSSSGIG<br>KTGQQPAKKRLNFGQTGDSESVPDPQPLGEPPAAPSGVGS<br>NTMASGGGAPMADNNEGADGVGNSSGNWHCDSTWLGDRVI<br>TTSTRTWALPTYNNHLYKQISNGTSGGSTNDNTYFGYSTP<br>WGYFDFNRFHCHFSPRDWQRLINNNWGFRPKRLNFKLFNI<br>QVKEVTTNEGTKTIANNLTSTVQVFTDSEYQLPYVLGSAH<br>QGCLPPFPADVFMIPQYGYLTLNNGSQAVGRSSFYCLEYF<br>PSQMLRTGNNFQSYTFEDVPFHSSYAHSQSLDRLMNPLI<br>DQYLYFLSRTINGSGQNQQTLKFSVAGPSNMAVQGRNYIP<br>GPSYRQQRVSTTVTQNNNSEFAWPGASSWALNGRNSLMNP<br>GPAMASHKEGEDRFFPLSGSLIFGKQGTGRDNVDADKVMI<br>TNEEEIKTTNPVATESYGQVATNHQSAQTLAVPFKAQAQT<br>GWVQNQGVLPGMVWQNRDVYLQGPIWAKIPHTDGNFHPSP<br>LMGGFGLKHPPPQILIKNTPVPADPPTTFNQAKLNSFITQ<br>YSTGQVSVEIEWELQKENSKRWNPEIQYTSNYYKSTNVDF<br>AVNTEGVYSEPRPIGTRFLTRNL |
| AAVanc.110_9GH<br>SEQ ID NO: 126 | AAVanc.110 | AAV9 | GH | MAADGYLPDWLEDNLSEGIREWWDLKGAPKPKANQQKQD<br>DGRGLVLPGYKYLGPFNGLDKGEPVNAADAAALEHDKAYD<br>QQLKAGDNPYLRYNHADAEFQERLQEDTSFGGNLGRAVFQ<br>AKKRVLEPLGLVEEGAKTAPGKKRPVEQSPQEPDSSSGIG<br>KTGQQPAKKRLNFGQTGDSESVPDPQPLGEPPAAPSGVGS<br>NTMASGGGAPMADNNEGADGVGNSSGNWHCDSTWLGDRVI<br>TTSTRTWALPTYNNHLYKQISNGTSGGSTNDNTYFGYSTP<br>WGYFDFNRFHCHFSPRDWQRLINNNWGFRPKRLNFKLFNI<br>QVKEVTTNEGTKTIANNLTSTVQVFTDSEYQLPYVLGSAH<br>QGCLPPFPADVFMIPQYGYLTLNNGSQAVGRSSFYCLEYF<br>PSQMLRTGNNFQSYTFEDVPFHSSYAHSQSLDRLMNPLI<br>DQYLYFLSRTINGSGQNQQTLKFSVAGPSNMAVQGRNYIP<br>GPSYRQQRVSTTVTQNNNSEFAWPGASSWALNGRNSLMNP<br>GPAMASHKEGEDRFFPLSGSLIFGKQGTGRDNVDADKVMI<br>TNEEEIKTTNPVATESYGQVATNHQSAQAQAQTGWVQNQG<br>VLPGMVWQNRDVYLQGPIWAKIPHTDGNFHPSPLMGGFGL<br>KHPPPQILIKNTPVPADPPTTFNQAKLNSFITQYSTGQVS<br>VEIEWELQKENSKRWNPEIQYTSNYYKSTNVDFAVNTEGV<br>YSEPRPIGTRFLTRNL |
| AAVanc.110_9VRGBS<br>SEQ ID NO: 127 | AAVanc.110 | AAV9 | VRGBS | MAADGYLPDWLEDNLSEGIREWWDLKGAPKPKANQQKQD<br>DGRGLVLPGYKYLGPFNGLDKGEPVNAADAAALEHDKAYD<br>QQLKAGDNPYLRYNHADAEFQERLQEDTSFGGNLGRAVFQ<br>AKKRVLEPLGLVEEGAKTAPGKKRPVEQSPQEPDSSSGIG<br>KTGQQPAKKRLNFGQTGDSESVPDPQPLGEPPAAPSGVGS<br>NTMASGGGAPMADNNEGADGVGNSSGNWHCDSTWLGDRVI<br>TTSTRTWALPTYNNHLYKQISNSTSGGSTNDNTYFGYSTP<br>WGYFDFNRFHCHFSPRDWQRLINNNWGFRPKRLNFKLFNI<br>QVKEVTDNNGVKTIANNLTSTVQVFTDSEYQLPYVLGSAH<br>QGCLPPFPADVFMIPQYGYLTLNDGSQAVGRSSFYCLEYF<br>PSQMLRTGNNFQSYTFEDVPFHSSYAHSQSLDRLMNPLI<br>DQYLYFLSRTINGSGQNQQTLQFSVAGPSNMAVQARNWVP<br>GPCYRQQRVSTTVTQNNNSEFAWPGATKYHLNGRDSLMNP<br>GVAMASHKEGEDRFFPLSGVLIFGKQGTGRDNVDADKVMI<br>TNEEEIKTTNPVATEEYGAVATNHQSAQAQAQTGLVHNQG<br>VLPGMVWQNRDVYLQGPIWAKIPHTDGNFHPSPLMGGFGL<br>KHPPPQILIKNTPVPADPPTTFNQAKLNSFITQYSTGQVS<br>VEIEWELQKENSKRWNPEIQYTSNYYKSNNVEFAVNTEGV<br>YSEPRPIGTRFLTRNL |
| AAVanc.110_8GH<br>SEQ ID NO: 128 | AAVanc.110 | AAV8 | GH | MAADGYLPDWLEDNLSEGIREWWDLKGAPKPKANQQKQD<br>DGRGLVLPGYKYLGPFNGLDKGEPVNAADAAALEHDKAYD<br>QQLKAGDNPYLRYNHADAEFQERLQEDTSFGGNLGRAVFQ<br>AKKRVLEPLGLVEEGAKTAPGKKRPVEQSPQEPDSSSGIG<br>KTGQQPAKKRLNFGQTGDSESVPDPQPLGEPPAAPSGVGS<br>NTMASGGGAPMADNNEGADGVGNSSGNWHCDSTWLGDRVI<br>TTSTRTWALPTYNNHLYKQISNGTSGGSTNDNTYFGYSTP |

TABLE 3-continued

| Name/<br>SEQ ID NO: | Backbone<br>Sequence | Donor<br>Sequence | Substitution | VP1 Amino Acid Sequence |
|---|---|---|---|---|
| | | | | WGYFDFNRFHCHFSPRDWQRLINNNWGFRPKRLNFKLFNI<br>QVKEVTTNEGTKTIANNLTSTVQVFTDSEYQLPYVLGSAH<br>QGCLPPFPADVFMIPQYGYLTLNNGSQAVGRSSFYCLEYF<br>PSQMLRTGNNFQFSYTFEDVPFHSSYAHSQSLDRLMNPLI<br>DQYLYFLSRTQTTGGTANTQTLGFSQGGPNTMANQAKNWL<br>PGPCYRQQRVSTTTGQNNNSNFAWTAGTKYHLNGRNSLAN<br>PGIAMATHKDDEERFFPSNGILIFGKQNAARDNADYSDVM<br>LTSEEEIKTTNPVATEEYGIVADNLQQQNTAPQIGTVNSQ<br>GVLPGMVWQNRDVYLQGPIWAKIPHTDGNFHPSPLMGGFG<br>LKHPPPQILIKNTPVPADPPTTFNQAKLNSFITQYSTGQV<br>SVEIEWELQKENSKRWNPEIQYTSNYYKSTNVDFAVNTEG<br>VYSEPRPIGTRFLTRNL |
| AAV9_anc.110VR<br>SEQ ID NO: 129 | AAV9 | AAVanc.110 | VR | MAADGYLPDWLEDNLSEGIREWWALKPGAPQPKANQQHQD<br>NARGLVLPGYKYLGPGNGLDKGEPVNAADAAALEHDKAYD<br>QQLKAGDNPYLKYNHADAEFQERLKEDTSFGGNLGRAVFQ<br>AKKRLLEPLGLVEEAAKTAPGKKRPVEQSPQEPDSSAGIG<br>KSGAQPAKKRLNFGQTGDTESVPDPQPIGEPPAAPSGVGS<br>LTMASGGGAPVADNNEGADGVGSSSGNWHCDSQWLGDRVI<br>TTSTRTWALPTYNNHLYKQISNGTSGGSTNDNAYFGYSTP<br>WGYFDFNRFHCHFSPRDWQRLINNNWGFRPKRLNFKLFNI<br>QVKEVTTNEGTKTIANNLTSTVQVFTDSDYQLPYVLGSAH<br>EGCLPPFPADVFMIPQYGYLTLNNGSQAVGRSSFYCLEYF<br>PSQMLRTGNNFQFSYEFENVPFHSSYAHSQSLDRLMNPLI<br>DQYLYFLSRTQTTGTAGTQTLKFSVAGPSNMAVQGRNYIP<br>GPSYRQQRVSTTTNQNNNSNFAWTGASSWALNGRNSLMNP<br>GPAMASHKDDEDRFFPSSGSLIFGKQGAGNDNVDYSQVMI<br>TNEEEIKTTNPVATESYGQVATNNQSANTQAQTGWVQNQG<br>ILPGMVWQDRDVYLQGPIWAKIPHTDGNFHPSPLMGGFGM<br>KHPPPQILIKNTPVPADPPTAFNKDKLNSFITQYSTGQVS<br>VEIEWELQKENSKRWNPEIQYTSNYYKSTNVDFAVNTEGV<br>YSEPRPIGTRFLTRNL |
| AAV9_anc.110GH<br>SEQ ID NO: 130 | AAV9 | AAVanc.110 | GH | MAADGYLPDWLEDNLSEGIREWWALKPGAPQPKANQQHQD<br>NARGLVLPGYKYLGPGNGLDKGEPVNAADAAALEHDKAYD<br>QQLKAGDNPYLKYNHADAEFQERLKEDTSFGGNLGRAVFQ<br>AKKRLLEPLGLVEEAAKTAPGKKRPVEQSPQEPDSSAGIG<br>KSGAQPAKKRLNFGQTGDTESVPDPQPIGEPPAAPSGVGS<br>LTMASGGGAPVADNNEGADGVGSSSGNWHCDSQWLGDRVI<br>TTSTRTWALPTYNNHLYKQISNSTSGGSSNDNAYFGYSTP<br>WGYFDFNRFHCHFSPRDWQRLINNNWGFRPKRLNFKLFNI<br>QVKEVTDNNGVKTIANNLTSTVQVFTDSDYQLPYVLGSAH<br>EGCLPPFPADVFMIPQYGYLTLNDGSQAVGRSSFYCLEYF<br>PSQMLRTGNNFQFSYEFENVPFHSSYAHSQSLDRLMNPLI<br>DQYLYFLSRTQTTGTAGTQTLQFSQAGPSSMANQARNWVP<br>GPCYRQQRVSTTTNQNNNSNFAWTGATKYHLNGRDSLMNP<br>GVAMASHKDDEDRFFPSSGVLIFGKQGAGNDNVDYSQVMI<br>TNEEEIKTTNPVATEEYGAVATNNQSANTQAQTGLVHNQG<br>ILPGMVWQDRDVYLQGPIWAKIPHTDGNFHPSPLMGGFGM<br>KHPPPQILIKNTPVPADPPTAFNKDKLNSFITQYSTGQVS<br>VEIEWELQKENSKRWNPEIQYTSNYYKSNNVEFAVNTEGV<br>YSEPRPIGTRFLTRNL |
| AAV8_anc.110VR<br>SEQ ID NO: 131 | AAV8 | AAVanc.110 | VR | MAADGYLPDWLEDNLSEGIREWWALKPGAPKPKANQQKQD<br>DGRGLVLPGYKYLGPFNGLDKGEPVNAADAAALEHDKAYD<br>QQLQAGDNPYLRYNHADAEFQERLQEDTSFGGNLGRAVFQ<br>AKKRVLEPLGLVEEGAKTAPGKKRPVEPSPQRSPDSSTGI<br>GKKGQQPARKRLNFGQTGDSESVPDPQPLGEPPAAPSGVG<br>PNTMAAGGGAPMADNNEGADGVGSSSGNWHCDSTWLGDRV<br>ITTSTRTWALPTYNNHLYKQISNGTSGGSTNDNTYFGYST<br>PWGYFDFNRFHCHFSPRDWQRLINNNWGFRPKRLSFKLFN<br>IQVKEVTTNEGTKTIANNLTSTIQVFTDSEYQLPYVLGSA<br>HQGCLPPFPADVFMIPQYGYLTLNNGSQAVGRSSFYCLEY<br>FPSQMLRTGNNFQFTYTFEDVPFHSSYAHSQSLDRLMNPL<br>IDQYLYFLSRTQTTGTAGTQTLGFSQGGPNTMANQAKNWL<br>PGPCYRQQRVSTTTNQNNNSNFAWTGGTKYHLNGRNSLAN<br>PGIAMATHKDDEDRFFPSSGILIFGKQGAGNDNVDYSQVM<br>LTSEEEIKTTNPVATEEYGIVATNNQSANTQAQTGTVNSQ<br>GALPGMVWQNRDVYLQGPIWAKIPHTDGNFHPSPLMGGFG<br>LKHPPPQILIKNTPVPADPPTTFNQSKLNSFITQYSTGQV<br>SVEIEWELQKENSKRWNPEIQYTSNYYKSTNVDFAVNTEG<br>VYSEPRPIGTRFLTRNL |
| AAV8_anc.110GH<br>SEQ ID NO: 132 | AAV8 | AAVanc.110 | GH | MAADGYLPDWLEDNLSEGIREWWALKPGAPKPKANQQKQD<br>DGRGLVLPGYKYLGPFNGLDKGEPVNAADAAALEHDKAYD<br>QQLQAGDNPYLRYNHADAEFQERLQEDTSFGGNLGRAVFQ<br>AKKRVLEPLGLVEEGAKTAPGKKRPVEPSPQRSPDSSTGI |

TABLE 3-continued

| Name/<br>SEQ ID NO: | Backbone<br>Sequence | Donor<br>Sequence | Substitution | VP1 Amino Acid Sequence |
|---|---|---|---|---|
| | | | | GKKGQQPARKRLNFGQTGDSESVPDPQPLGEPPAAPSGVG<br>PNTMAAGGGAPMADNNEGADGVGSSSGNWHCDSTWLGDRV<br>ITTSTRTWALPTYNNHLYKQISNGTSGGATNDNTYFGYST<br>PWGYFDFNRFHCHFSPRDWQRLINNNWGFRPKRLSFKLFN<br>IQVKEVTQNEGTKTIANNLTSTIQVFTDSEYQLPYVLGSA<br>HQGCLPPFPADVFMIPQYGYLTLNNGSQAVGRSSFYCLEY<br>FPSQMLRTGNNFQFTYTFEDVPFHSSYAHSQSLDRLMNPL<br>IDQYLYFLSRTQTTGTAGTQTLQFSQAGPSSMANQARNWV<br>PGPCYRQQRVSTTTNQNNNSNFAWTGATKYHLNGRDSLMN<br>PGVAMASHKDDEDRFFPSSGVLIFGKQGAGNDNVDYSQVM<br>ITNEEEIKTTNPVATEEYGAVATNNQSANTQAQTGLVHNQ<br>GALPGMVWQNRDVYLQGPIWAKIPHTDGNFHPSPLMGGFG<br>LKHPPPQILIKNTPVPADPPTTFNQSKLNSFITQYSTGQV<br>SVEIEWELQKENSKRWNPEIQYTSNYYKSTSVDFAVNTEG<br>VYSEPRPIGTRFLTRNL |
| Anc.110_8VR<br>SEQ ID NO: 133 | AAVanc.110 | AAV8 | VR | MAADGYLPDWLEDNLSEGIREWWDLKPGAPKPKANQQKQD<br>DGRGLVLPGYKYLGPFNGLDKGEPVNAADAAALEHDKAYD<br>QQLKAGDNPYLRYNHADAEFQERLQEDTSFGGNLGRAVFQ<br>AKKRVLEPLGLVEEGAKTAPGKKRPVEQSPQEPDSSSGIG<br>KTGQQPAKKRLNFGQTGDSESVPDPQPLGEPPAAPSGVGS<br>NTMASGGGAPMADNNEGADGVGNSSGNWHCDSTWLGDRVI<br>TTSTRTWALPTYNNHLYKQISNGTSGGATNDNTYFGYSTP<br>WGYFDFNRFHCHFSPRDWQRLINNNWGFRPKRLNFKLFNI<br>QVKEVTQNEGTKTIANNLTSTVQVFTDSEYQLPYVLGSAH<br>QGCLPPFPADVFMIPQYGYLTLNNGSQAVGRSSFYCLEYF<br>PSQMLRTGNNFQFSYTFEDVPFHSSYAHSQSLDRLMNPLI<br>DQYLYFLSRTQTTGGTANTQTLQFSQAGPSSMANQARNWV<br>PGPCYRQQRVSTTTGQNNNSNFAWTAATKYHLNGRDSLMN<br>PGVAMASHKDDEERFFPSNGVLIFGKQNAARDNADYSDVM<br>ITNEEEIKTTNPVATEEYGAVADNLQQQNTAPQIGLVHNQ<br>GVLPGMVWQNRDVYLQGPIWAKIPHTDGNFHPSPLMGGFG<br>LKHPPPQILIKNTPVPADPPTTFNQAKLNSFITQYSTGQV<br>SVEIEWELQKENSKRWNPEIQYTSNYYKSTSVDFAVNTEG<br>VYSEPRPIGTRFLTRNL |
| AAV8_6VR<br>SEQ ID NO: 134 | AAV8 | AAV6 | VR | MAADGYLPDWLEDNLSEGIREWWALKPGAPKPKANQQKQD<br>DGRGLVLPGYKYLGPFNGLDKGEPVNAADAAALEHDKAYD<br>QQLQAGDNPYLRYNHADAEFQERLQEDTSFGGNLGRAVFQ<br>AKKRVLEPLGLVEEGAKTAPGKKRPVEPSPQRSPDSSTGI<br>GKKGQQPARKRLNFGQTGDSESVPDPQPLGEPPAAPSGVG<br>PNTMAAGGGAPMADNNEGADGVGSSSGNWHCDSTWLGDRV<br>ITTSTRTWALPTYNNHLYKQISSASTGASNDNTYFGYSTP<br>WGYFDFNRFHCHFSPRDWQRLINNNWGFRPKRLSFKLFNI<br>QVKEVTTNDGVTTIANNLTSTIQVFTDSEYQLPYVLGSAH<br>QGCLPPFPADVFMIPQYGYLTLNNGSQAVGRSSFYCLEYF<br>PSQMLRTGNNFQFTYTFEDVPFHSSYAHSQSLDRLMNPLI<br>DQYLYYLSRTQNSGSAQNKDLGFSQGGPNTMANQAKNWL<br>PGPCYRQQRVSKTKTDNNNSNFTWTGATKYHLNGRNSLAN<br>PGIAMASHKDDKFFPMSGILIFGKESAGASNTALDNVM<br>LTSEEEIKTTNPVATEEYGIVAVNLQSSSTDPATGTVNSQ<br>GALPGMVWQNRDVYLQGPIWAKIPHTDGNFHPSPLMGGFG<br>LKHPPPQILIKNTPVPADPPTTFNQSKLNSFITQYSTGQV<br>SVEIEWELQKENSKRWNPEIQYTSNYAKSANVDFAVNTEG<br>VYSEPRPIGTRYLTRNL |
| AAV8_6VRGBS<br>SEQ ID NO: 135 | AAV8 | AAV6 | VRGBS | MAADGYLPDWLEDNLSEGIREWWALKPGAPKPKANQQKQD<br>DGRGLVLPGYKYLGPFNGLDKGEPVNAADAAALEHDKAYD<br>QQLQAGDNPYLRYNHADAEFQERLQEDTSFGGNLGRAVFQ<br>AKKRVLEPLGLVEEGAKTAPGKKRPVEPSPQRSPDSSTGI<br>GKKGQQPARKRLNFGQTGDSESVPDPQPLGEPPAAPSGVG<br>PNTMAAGGGAPMADNNEGADGVGSSSGNWHCDSTWLGDRV<br>ITTSTRTWALPTYNNHLYKQISSASTGASNDNTYFGYSTP<br>WGYFDFNRFHCHFSPRDWQRLINNNWGFRPKRLSFKLFNI<br>QVKEVTTNDGVTTIANNLTSTIQVFTDSEYQLPYVLGSAH<br>QGCLPPFPADVFMIPQYGYLTLNNGSQAVGRSSFYCLEYF<br>PSQMLRTGNNFQFTYTFEDVPFHSSYAHSQSLDRLMNPLI<br>DQYLYYLSRTQNSGSAQNKDLGFSRGSPAGMSVQAKNWL<br>PGPCYRQQRVSKTKTDNNNSNFTWTGATKYHLNGRNSLAN<br>PGIAMASHKDDKFFPMSGILIFGKESAGASNTALDNVM<br>LTSEEEIKTTNPVATEEYGIVAVNLQSSSTDPATGTVNSQ<br>GALPGMVWQNRDVYLQGPIWAKIPHTDGNFHPSPLMGGFG<br>LKHPPPQILIKNTPVPADPPTTFNQSKLNSFITQYSTGQV<br>SVEIEWELQKENSKRWNPEIQYTSNYAKSANVDFAVNTEG<br>VYSEPRPIGTRYLTRNL |

TABLE 3-continued

| Name/<br>SEQ ID NO: | Backbone<br>Sequence | Donor<br>Sequence | Substitution | VP1 Amino Acid Sequence |
|---|---|---|---|---|
| AAV8_6VRGH<br>SEQ ID NO: 136 | AAV8 | AAV6 | VRGH | MAADGYLPDWLEDNLSEGIREWWALKPGAPKPKANQQKQD<br>DGRGLVLPGYKYLGPFNGLDKGEPVNAADAAALEHDKAYD<br>QQLQAGDNPYLRYNHADAEFQERLQEDTSFGGNLGRAVFQ<br>AKKRVLEPLGLVEEGAKTAPGKKRPVEPSPQRSPDSSTGI<br>GKKGQQPARKRLNFGQTGDSESVPDPQPLGEPPAAPSGVG<br>PNTMAAGGGAPMADNNEGADGVGSSSGNWHCDSTWLGDRV<br>ITTSTRTWALPTYNNHLYKQISSASTGASNDNTYFGYSTP<br>WGYFDFNRFHCHFSPRDWQRLINNNWGFRPKRLSFKLFNI<br>QVKEVTTNDGVTTIANNLTSTIQVFTDSEYQLPYVLGSAH<br>QGCLPPFPADVFMIPQYGYLTLNNGSQAVGRSSFYCLEYF<br>PSQMLRTGNNFQFTYTFEDVPFHSSYAHSQSLDRLMNPLI<br>DQYLYYLNRTQNQSGSAQNKDLLFSRGSPAGMSVQPKNWL<br>PGPCYRQQRVSKTKTDNNNSNFTWTGASKYNLNGRESIIN<br>PGTAMASHKDDKDKFFPMSGVMIFGKESAGASNTALDNVM<br>ITDEEEIKATNPVATERFGTVAVNLQSSSTDPATGDVHVM<br>GALPGMVWQNRDVYLQGPIWAKIPHTDGNFHPSPLMGGFG<br>LKHPPPQILIKNTPVPADPPTTFNQSKLNSFITQYSTGQV<br>SVEIEWELQKENSKRWNPEIQYTSNYAKSANVDFAVNTEG<br>VYSEPRPIGTRYLTRNL |
| AAV8_9VRGBS.SA<br>SEQ ID NO: 137 | AAV8 | AAV9 | VRGBS.SA | MAADGYLPDWLEDNLSEGIREWWALKPGAPKPKANQQKQD<br>DGRGLVLPGYKYLGPFNGLDKGEPVNAADAAALEHDKAYD<br>QQLQAGDNPYLRYNHADAEFQERLQEDTSFGGNLGRAVFQ<br>AKKRVLEPLGLVEEGAKTAPGKKRPVEPSPQRSPDSSTGI<br>GKKGQQPARKRLNFGQTGDSESVPDPQPLGEPPAAPSGVG<br>PNTMAAGGGAPMADNNEGADGVGSSSGNWHCDSTWLGDRV<br>ITTSTRTWALPTYNNHLYKQISNSTSGGSSNDNTYFGYST<br>PWGYFDFNRFHCHFSPRDWQRLINNNWGFRPKRLSFKLFN<br>IQVKEVTDNNGVKTIANNLTSTIQVFTDSEYQLPYVLGSA<br>HQGCLPPFPADVFMIPQYGYLTLNDGSQAVGRSSFYCLEY<br>FPSQMLRTGNNFQFTYTFEDVPFHSSYAHSQSLDRLMNPL<br>IDQYLYYLSRTINGSGQNQQTLGFSVAGPANMAVQGRNWL<br>PGPCYRQQRVSTTVTQNNNSEFAWPGGTKYHLNGRNSLAN<br>PGIAMATHKEGEDRFFPLSGILIFGKQGTGRDNVDADKVM<br>LTSEEEIKTTNPVATEEYGIVATNHQSAQAQAQTGTVNSQ<br>GALPGMVWQNRDVYLQGPIWAKIPHTDGNFHPSPLMGGFG<br>LKHPPPQILIKNTPVPADPPTTFNQSKLNSFITQYSTGQV<br>SVEIEWELQKENSKRWNPEIQYTSNYYKSNNVEFAVNTEG<br>VYSEPRPIGTRYLTRNL |
| AAV8_9VRGBS.ST<br>SEQ ID NO: 138 | AAV8 | AAV9 | VRGBS.ST | MAADGYLPDWLEDNLSEGIREWWALKPGAPKPKANQQKQD<br>DGRGLVLPGYKYLGPFNGLDKGEPVNAADAAALEHDKAYD<br>QQLQAGDNPYLRYNHADAEFQERLQEDTSFGGNLGRAVFQ<br>AKKRVLEPLGLVEEGAKTAPGKKRPVEPSPQRSPDSSTGI<br>GKKGQQPARKRLNFGQTGDSESVPDPQPLGEPPAAPSGVG<br>PNTMAAGGGAPMADNNEGADGVGSSSGNWHCDSTWLGDRV<br>ITTSTRTWALPTYNNHLYKQISNSTSGGSSNDNTYFGYST<br>PWGYFDFNRFHCHFSPRDWQRLINNNWGFRPKRLSFKLFN<br>IQVKEVTDNNGVKTIANNLTSTIQVFTDSEYQLPYVLGSA<br>HQGCLPPFPADVFMIPQYGYLTLNDGSQAVGRSSFYCLEY<br>FPSQMLRTGNNFQFTYTFEDVPFHSSYAHSQSLDRLMNPL<br>IDQYLYYLSRTINGSGQNQQTLGFSVAGPTNMAVQGRNWL<br>PGPCYRQQRVSTTVTQNNNSEFAWPGGTKYHLNGRNSLAN<br>PGIAMATHKEGEDRFFPLSGILIFGKQGTGRDNVDADKVM<br>LTSEEEIKTTNPVATEEYGIVATNHQSAQAQAQTGTVNSQ<br>GALPGMVWQNRDVYLQGPIWAKIPHTDGNFHPSPLMGGFG<br>LKHPPPQILIKNTPVPADPPTTFNQSKLNSFITQYSTGQV<br>SVEIEWELQKENSKRWNPEIQYTSNYYKSNNVEFAVNTEG<br>VYSEPRPIGTRYLTRNL |
| AAV8_9VRGBS.MA<br>SEQ ID NO: 139 | AAV8 | AAV9 | VRGBS.MA | MAADGYLPDWLEDNLSEGIREWWALKPGAPKPKANQQKQD<br>DGRGLVLPGYKYLGPFNGLDKGEPVNAADAAALEHDKAYD<br>QQLQAGDNPYLRYNHADAEFQERLQEDTSFGGNLGRAVFQ<br>AKKRVLEPLGLVEEGAKTAPGKKRPVEPSPQRSPDSSTGI<br>GKKGQQPARKRLNFGQTGDSESVPDPQPLGEPPAAPSGVG<br>PNTMAAGGGAPMADNNEGADGVGSSSGNWHCDSTWLGDRV<br>ITTSTRTWALPTYNNHLYKQISNSTSGGSSNDNTYFGYST<br>PWGYFDFNRFHCHFSPRDWQRLINNNWGFRPKRLSFKLFN<br>IQVKEVTDNNGVKTIANNLTSTIQVFTDSEYQLPYVLGSA<br>HQGCLPPFPADVFMIPQYGYLTLNDGSQAVGRSSFYCLEY<br>FPSQMLRTGNNFQFTYTFEDVPFHSSYAHSQSLDRLMNPL<br>IDQYLYYLSRTINGSGQNQQTLGFSVAGPSN,AVQGRNWL<br>PGPCYRQQRVSTTVTQNNNSEFAWPGGTKYHLNGRNSLAN<br>PGIAMATHKEGEDRFFPLSGILIFGKQGTGRDNVDADKVM<br>LTSEEEIKTTNPVATEEYGIVATNHQSAQAQAQTGTVNSQ<br>GALPGMVWQNRDVYLQGPIWAKIPHTDGNFHPSPLMGGFG |

TABLE 3-continued

| Name/<br>SEQ ID NO: | Backbone<br>Sequence | Donor<br>Sequence | Substitution | VP1 Amino Acid Sequence |
|---|---|---|---|---|
| | | | | LKHPPPQILIKNTPVPADPPTTFNQSKLNSFITQYSTGQV<br>SVEIEWELQKENSKRWNPEIQYTSNYYKSNNVEFAVNTEG<br>VYSEPRPIGTRYLTRNL |
| AAV8_9VRGBS.MI<br>SEQ ID NO: 140 | AAV8 | AAV9 | VRGBS.MI | MAADGYLPDWLEDNLSEGIREWWALKPGAPKPKANQQKQD<br>DGRGLVLPGYKYLGPFNGLDKGEPVNAADAAALEHDKAYD<br>QQLQAGDNPYLRYNHADAEFQERLQEDTSFGGNLGRAVFQ<br>AKKRVLEPLGLVEEGAKTAPGKKRPVEPSPQRSPDSSTGI<br>GKKGQQPARKRLNFGQTGDSESVPDPQPLGEPPAAPSGVG<br>PNTMAAGGGAPMADNNEGADGVGSSSGNWHCDSTWLGDRV<br>ITTSTRTWALPTYNNHLYKQISNSTSGGSSNDNTYFGYST<br>PWGYFDFNRFHCHFSPRDWQRLINNNWGFRPKRLSFKLFN<br>IQVKEVTDNNGVKTIANNLTSTIQVFTDSEYQLPYVLGSA<br>HQGCLPPFPADVFMIPQYGYLTLNDGSQAVGRSSFYCLEY<br>FPSQMLRTGNNFQFTYTFEDVPFHSSYAHSQSLDRLMNPL<br>IDQYLYYLSRTINGSGQNQQTLGFSVAGPSN,AVQGRNWL<br>PGPCYRQQRVSTTVTQNNNSEFAWPGGTKYHLNGRNSLAN<br>PGIAMATHKEGEDRFFPLSGILIFGKQGTGRDNVDADKVM<br>LTSEEEIKTTNPVATEEYGIVATNHQSAQAQAQTGTVNSQ<br>GALPGMVWQNRDVYLQGPIWAKIPHTDGNFHPSPLMGGFG<br>LKHPPPQILIKNTPVPADPPTTFNQSKLNSFITQYSTGQV<br>SVEIEWELQKENSKRWNPEIQYTSNYYKSNNVEFAVNTEG<br>VYSEPRPIGTRYLTRNL |
| AAV8_9VRGBS.MK<br>SEQ ID NO: 141 | AAV8 | AAV9 | VRGBS.MK | MAADGYLPDWLEDNLSEGIREWWALKPGAPKPKANQQKQD<br>DGRGLVLPGYKYLGPFNGLDKGEPVNAADAAALEHDKAYD<br>QQLQAGDNPYLRYNHADAEFQERLQEDTSFGGNLGRAVFQ<br>AKKRVLEPLGLVEEGAKTAPGKKRPVEPSPQRSPDSSTGI<br>GKKGQQPARKRLNFGQTGDSESVPDPQPLGEPPAAPSGVG<br>PNTMAAGGGAPMADNNEGADGVGSSSGNWHCDSTWLGDRV<br>ITTSTRTWALPTYNNHLYKQISNSTSGGSSNDNTYFGYST<br>PWGYFDFNRFHCHFSPRDWQRLINNNWGFRPKRLSFKLFN<br>IQVKEVTDNNGVKTIANNLTSTIQVFTDSEYQLPYVLGSA<br>HQGCLPPFPADVFMIPQYGYLTLNDGSQAVGRSSFYCLEY<br>FPSQMLRTGNNFQFTYTFEDVPFHSSYAHSQSLDRLMNPL<br>IDQYLYYLSRTINGSGQNQQTLGFSVAGPSNKAVQGRNWL<br>PGPCYRQQRVSTTVTQNNNSEFAWPGGTKYHLNGRNSLAN<br>PGIAMATHKEGEDRFFPLSGILIFGKQGTGRDNVDADKVM<br>LTSEEEIKTTNPVATEEYGIVATNHQSAQAQAQTGTVNSQ<br>GALPGMVWQNRDVYLQGPIWAKIPHTDGNFHPSPLMGGFG<br>LKHPPPQILIKNTPVPADPPTTFNQSKLNSFITQYSTGQV<br>SVEIEWELQKENSKRWNPEIQYTSNYYKSNNVEFAVNTEG<br>VYSEPRPIGTRYLTRNL |
| AAV8_9VRGBS.PA<br>SEQ ID NO: 142 | AAV8 | AAV9 | VRGBS.PA | MAADGYLPDWLEDNLSEGIREWWALKPGAPKPKANQQKQD<br>DGRGLVLPGYKYLGPFNGLDKGEPVNAADAAALEHDKAYD<br>QQLQAGDNPYLRYNHADAEFQERLQEDTSFGGNLGRAVFQ<br>AKKRVLEPLGLVEEGAKTAPGKKRPVEPSPQRSPDSSTGI<br>GKKGQQPARKRLNFGQTGDSESVPDPQPLGEPPAAPSGVG<br>PNTMAAGGGAPMADNNEGADGVGSSSGNWHCDSTWLGDRV<br>ITTSTRTWALPTYNNHLYKQISNSTSGGSSNDNTYFGYST<br>PWGYFDFNRFHCHFSPRDWQRLINNNWGFRPKRLSFKLFN<br>IQVKEVTDNNGVKTIANNLTSTIQVFTDSEYQLPYVLGSA<br>HQGCLPPFPADVFMIPQYGYLTLNDGSQAVGRSSFYCLEY<br>FPSQMLRTGNNFQFTYTFEDVPFHSSYAHSQSLDRLMNPL<br>IDQYLYYLSRTINGSGQNQQTLGFSVAGASNMAVQGRNWL<br>PGPCYRQQRVSTTVTQNNNSEFAWPGGTKYHLNGRNSLAN<br>PGIAMATHKEGEDRFFPLSGILIFGKQGTGRDNVDADKVM<br>LTSEEEIKTTNPVATEEYGIVATNHQSAQAQAQTGTVNSQ<br>GALPGMVWQNRDVYLQGPIWAKIPHTDGNFHPSPLMGGFG<br>LKHPPPQILIKNTPVPADPPTTFNQSKLNSFITQYSTGQV<br>SVEIEWELQKENSKRWNPEIQYTSNYYKSNNVEFAVNTEG<br>VYSEPRPIGTRYLTRNL |
| AAVanc110_9VRHS<br>SEQ ID NO: 143 | AAVanc.110 | AAV9 | VRHS | MAADGYLPDWLEDNLSEGIREWWDLKPGAPKPKANQQKQD<br>DGRGLVLPGYKYLGPFNGLDKGEPVNAADAAALEHDKAYD<br>QQLKAGDNPYLRYNHADAEFQERLQEDTSFGGNLGRAVFQ<br>AKKRVLEPLGLVEEGAKTAPGKKRPVEQSPQEPDSSSGIG<br>KTGQQPAKKRLNFGQTGDSESVPDPQPLGEPPAAPSGVGS<br>NTMASGGGAPMADNNEGADGVGNSSGNWHCDSTWLGDRVI<br>TTSTRTWALPTYNNHLYKQISNSTSGGSSNDNTYFGYSTP<br>WGYFDFNRFHCHFSPRDWQRLINNNWGFRPKRLNFKLFNI<br>QVKEVTDNNGVKTIANNLTSTVQVFTDSEYQLPYVLGSAH<br>QGCLPPFPADVFMIPQYGYLTLNDGSQAVGRSSFYCLEYF<br>PSQMLRTGNNFQFSYTFEDVPFHSSYAHSQSLDRLMNPLI<br>DQYLYFLSRTINGSGQNQQTLQFSQAGPSSMANQARNWVP<br>GPCYRQQRVSTTVTQNNNSEFAWPGATKYHLNGRDSLMNP |

TABLE 3-continued

| Name/<br>SEQ ID NO: | Backbone<br>Sequence | Donor<br>Sequence | Substitution | VP1 Amino Acid Sequence |
|---|---|---|---|---|
| | | | | GVAMASHKEGEDRFFPLSGVLIFGKQGTGRDNVDADKVMI<br>TNEEEIKTTNPVATEEYGAVATNHQRGNRQAQTGLVHNQG<br>VLPGMVWQNRDVYLQGPIWAKIPHTDGNFHPSPLMGGFGL<br>KHPPPQILIKNTPVPADPPTTFNQAKLNSFITQYSTGQVS<br>VEIEWELQKENSKRWNPEIQYTSNYYKSNNVEFAVNTEGV<br>YSEPRPIGTRFLTRNL |
| AAV8_5VR<br>SEQ ID NO: 144 | AAV8 | AAV5 | VR | MAADGYLPDWLEDNLSEGIREWWALKPGAPKPKANQQKQD<br>DGRGLVLPGYKYLGPFNGLDKGEPVNAADAAALEHDKAYD<br>QQLQAGDNPYLRYNHADAEFQERLQEDTSFGGNLGRAVFQ<br>AKKRVLEPLGLVEEGAKTAPGKKRPVEPSPQRSPDSSTGI<br>GKKGQQPARKRLNFGQTGDSESVPDPQPLGEPPAAPSGVG<br>PNTMAAGGGAPMADNNEGADGVGSSSGNWHCDSTWLGDRV<br>ITTSTRTWALPTYNNHLYKQIKSGSVDGSNDNTYFGYSTP<br>WGYFDFNRFHCHFSPRDWQRLINNNWGFRPKRLSFKLFNI<br>QVKEVTVQDSTTTIANNLTSTIQVFTDSEYQLPYVLGSAH<br>QGCLPPFPADVFMIPQYGYLTLNRDNTENPTERSSFYCLE<br>YFPSQMLRTGNNFQFTYTFEDVPFHSSYAHSQSLDRLMNP<br>LIDQYLYYLSRTNTGGVQFSQGGPNTMANQAKNWLPGPCY<br>RQQGWNLGSGVNRASVSAFATGTKYHLNGRNSLANPGIAM<br>ATNNLQGSNTYALENTLIFNSQPANPGTTATYLEGNMLTS<br>EEEIKTTNPVATEEYGIVATNNQSSTTAPATGTVNSQGAL<br>PGMVWQNRDVYLQGPIWAKIPHTDGNFHPSPLMGGFGLKH<br>PPPQILIKNTPVPADPPTTFNQSKLNSFITQYSTGQVSVE<br>IEWELQKENSKRWNPEIQYTSNYNDPQFVDFAVNTEGVYS<br>EPRPIGTRYLTRNL |
| Anc110_5VR<br>SEQ ID NO: 145 | Anc110 | AAV5 | VR | MAADGYLPDWLEDNLSEGIREWWDLKPGAPKPKANQQKQD<br>DGRGLVLPGYKYLGPFNGLDKGEPVNAADAAALEHDKAYD<br>QQLKAGDNPYLRYNHADAEFQERLQEDTSFGGNLGRAVFQ<br>AKKRVLEPLGLVEEGAKTAPGKKRPVEQSPQEPDSSSGIG<br>KTGQQPAKKRLNFGQTGDSESVPDPQPLGEPPAAPSGVGS<br>NTMASGGGAPMADNNEGADGVGNSSGNWHCDSTWLGDRVI<br>TTSTRTWALPTYNNHLYKQIKSGSVDGSNDNTYFGYSTPW<br>GYFDFNRFHCHFSPRDWQRLINNNWGFRPKRLNFKLFNIQ<br>VKEVTVQDSTTTIANNLTSTVQVFTDSEYQLPYVLGSAHQ<br>GCLPPFPADVFMIPQYGYLTLNRDNTENPTERSSFYCLEY<br>FPSQMLRTGNNFQFSYTFEDVPFHSSYAHSQSLDRLMNPL<br>IDQYLYFLSRTNTGGVQFSQAGPSSMANQARNWVPGPCYR<br>QQGWNLGSGVNRASVSAFATATKYHLNGRDSLMNPGVAMA<br>SNNLQGSNTYALENTLIFNSQPANPGTTATYLEGNMITNE<br>EEIKTTNPVATEEYGAVATNNQSSTTAPATGLVHNQGVLP<br>GMVWQNRDVYLQGPIWAKIPHTDGNFHPSPLMGGFGLKHP<br>PPQILIKNTPVPADPPTTFNQAKLNSFITQYSTGQVSVEI<br>EWELQKENSKRWNPEIQYTSNYNDPQFVDFAVNTEGVYSE<br>PRPIGTRFLTRNL |
| AAV8_6VR<br>SEQ ID NO: 146 | AAV8 | AAV6 | VR | MAADGYLPDWLEDNLSEGIREWWALKPGAPKPKANQQKQD<br>DGRGLVLPGYKYLGPFNGLDKGEPVNAADAAALEHDKAYD<br>QQLQAGDNPYLRYNHADAEFQERLQEDTSFGGNLGRAVFQ<br>AKKRVLEPLGLVEEGAKTAPGKKRPVEPSPQRSPDSSTGI<br>GKKGQQPARKRLNFGQTGDSESVPDPQPLGEPPAAPSGVG<br>PNTMAAGGGAPMADNNEGADGVGSSSGNWHCDSTWLGDRV<br>ITTSTRTWALPTYNNHLYKQISSASTGASNDNTYFGYSTP<br>WGYFDFNRFHCHFSPRDWQRLINNNWGFRPKRLSFKLFNI<br>QVKEVTTNDGVTTIANNLTSTIQVFTDSEYQLPYVLGSAH<br>QGCLPPFPADVFMIPQYGYLTLNNGSQAVGRSSFYCLEYF<br>PSQMLRTGNNFQFTYTFEDVPFHSSYAHSQSLDRLMNPLI<br>DQYLYYLSRTNQSGSAQNKDLGFSQGGPNTMANQAKNWL<br>PGPCYRQQRVSKTKTDNNNSNFTWTGATKYHLNGRNSLAN<br>PGIAMASHKDDKDKFFPMSGILIFGKESAGASNTALDNVM<br>LTSEEEIKTTNPVATEEYGIVAVNLQSSSTDPATGTVNSQ<br>GALPGMVWQNRDVYLQGPIWAKIPHTDGNFHPSPLMGGFG<br>LKHPPPQILIKNTPVPADPPTTFNQSKLNSFITQYSTGQV<br>SVEIEWELQKENSKRWNPEIQYTSNYAKSANVDFAVNTEG<br>VYSEPRPIGTRYLTRNL |
| AAV8_6VRGBS<br>SEQ ID NO: 147 | AAV8 | AAV6 | VRGBS | MAADGYLPDWLEDNLSEGIREWWALKPGAPKPKANQQKQD<br>DGRGLVLPGYKYLGPFNGLDKGEPVNAADAAALEHDKAYD<br>QQLQAGDNPYLRYNHADAEFQERLQEDTSFGGNLGRAVFQ<br>AKKRVLEPLGLVEEGAKTAPGKKRPVEPSPQRSPDSSTGI<br>GKKGQQPARKRLNFGQTGDSESVPDPQPLGEPPAAPSGVG<br>PNTMAAGGGAPMADNNEGADGVGSSSGNWHCDSTWLGDRV<br>ITTSTRTWALPTYNNHLYKQISSASTGASNDNTYFGYSTP<br>WGYFDFNRFHCHFSPRDWQRLINNNWGFRPKRLSFKLFNI<br>QVKEVTTNDGVTTIANNLTSTIQVFTDSEYQLPYVLGSAH<br>QGCLPPFPADVFMIPQYGYLTLNNGSQAVGRSSFYCLEYF |

TABLE 3-continued

| Name/ SEQ ID NO: | Backbone Sequence | Donor Sequence | Substitution | VP1 Amino Acid Sequence |
|---|---|---|---|---|
| | | | | PSQMLRTGNNFQFTYTFEDVPFHSSYAHSQSLDRLMNPLI DQYLYYLSRTQNQSGSAQNKDLGFSRGSPAGMSVQAKNWL PGPCYRQQRVSKTKTDNNNSNFTWTGATKYHLNGRNSLAN PGIAMASHKDDKDKFFPMSGILIFGKESAGASNTALDNVM LTSEEEIKTTNPVATEEYGIVAVNLQSSSTDPATGTVNSQ GALPGMVWQNRDVYLQGPIWAKIPHTDGNFHPSPLMGGFG LKHPPPQILIKNTPVPADPPTTFNQSKLNSFITQYSTGQV SVEIEWELQKENSKRWNPEIQYTSNYAKSANVDFAVNTEG VYSEPRPIGTRYLTRNL |
| AAV8_6VRGH SEQ ID NO: 148 | AAV8 | AAV6 | VRGH | MAADGYLPDWLEDNLSEGIREWWALKPGAPKPKANQQKQD DGRGLVLPGYKYLGPFNGLDKGEPVNAADAAALEHDKAYD QQLQAGDNPYLRYNHADAEFQERLQEDTSFGGNLGRAVFQ AKKRVLEPLGLVEEGAKTAPGKKRPVEPSPQRSPDSSTGI GKKGQQPARKRLNFGQTGDSESVPDPQPLGEPPAAPSGVG PNTMAAGGGAPMADNNEGADGVGSSSGNWHCDSTWLGDRV ITTSTRTWALPTYNNHLYKQISSASTGASNDNTYFGYSTP WGYFDFNRFHCHFSPRDWQRLINNNWGFRPKRLSFKLFNI QVKEVTTNDGVTTIANNLTSTIQVFTDSEYQLPYVLGSAH QGCLPPFPADVFMIPQYGYLTLNNGSQAVGRSSFYCLEYF PSQMLRTGNNFQFTYTFEDVPFHSSYAHSQSLDRLMNPLI DQYLYYLNRTQNQSGSAQNKDLLFSRGSPAGMSVQPKNWL PGPCYRQQRVSKTKTDNNNSNFTWTGASKYNLNGRESIIN PGTAMASHKDDKDKFFPMSGVMIFGKESAGASNTALDNVM ITDEEEIKATNPVATERFGTVAVNLQSSSTDPATGDVHVM GALPGMVWQNRDVYLQGPIWAKIPHTDGNFHPSPLMGGFG LKHPPPQILIKNTPVPADPPTTFNQSKLNSFITQYSTGQV SVEIEWELQKENSKRWNPEIQYTSNYAKSANVDFAVNTEG VYSEPRPIGTRYLTRNL |
| AAV8_7VRGBS SEQ ID NO: 149 | AAV8 | AAV7 | VRGBS | MAADGYLPDWLEDNLSEGIREWWALKPGAPKPKANQQKQD DGRGLVLPGYKYLGPFNGLDKGEPVNAADAAALEHDKAYD QQLQAGDNPYLRYNHADAEFQERLQEDTSFGGNLGRAVFQ AKKRVLEPLGLVEEGAKTAPGKKRPVEPSPQRSPDSSTGI GKKGQQPARKRLNFGQTGDSESVPDPQPLGEPPAAPSGVG PNTMAAGGGAPMADNNEGADGVGSSSGNWHCDSTWLGDRV ITTSTRTWALPTYNNHLYKQISSETAGSTNDNTYFGYSTP WGYFDFNRFHCHFSPRDWQRLINNNWGFRPKRLSFKLFNI QVKEVTTNDGVTTIANNLTSTIQVFTDSEYQLPYVLGSAH QGCLPPFPADVFMIPQYGYLTLNNGSQAVGRSSFYCLEYF PSQMLRTGNNFQFTYTFEDVPFHSSYAHSQSLDRLMNPLI DQYLYYLSRTQSNPGGTAGNRELGFSQGGPSTMAEQAKNW LPGPCYRQQRVSKTLDQNNNSNFAWTGATKYHLNGRNSLA NPGIAMATHKDDEDRFFPSSGILIFGKTGATNKTTLENVM LTSEEEIKTTNPVATEEYGIVSSNLQAANTAAQTGTVNSQ GALPGMVWQNRDVYLQGPIWAKIPHTDGNFHPSPLMGGFG LKHPPPQILIKNTPVPADPPTTFNQSKLNSFITQYSTGQV SVEIEWELQKENSKRWNPEIQYTSNFEKQTGVDFAVNTEG VYSEPRPIGTRYLTRNL |
| AAV8_7VRGH SEQ ID NO: 150 | AAV8 | AAV7 | VRGH | MAADGYLPDWLEDNLSEGIREWWALKPGAPKPKANQQKQD DGRGLVLPGYKYLGPFNGLDKGEPVNAADAAALEHDKAYD QQLQAGDNPYLRYNHADAEFQERLQEDTSFGGNLGRAVFQ AKKRVLEPLGLVEEGAKTAPGKKRPVEPSPQRSPDSSTGI GKKGQQPARKRLNFGQTGDSESVPDPQPLGEPPAAPSGVG PNTMAAGGGAPMADNNEGADGVGSSSGNWHCDSTWLGDRV ITTSTRTWALPTYNNHLYKQISSETAGSTNDNTYFGYSTP WGYFDFNRFHCHFSPRDWQRLINNNWGFRPKRLSFKLFNI QVKEVTTNDGVTTIANNLTSTIQVFTDSEYQLPYVLGSAH QGCLPPFPADVFMIPQYGYLTLNNGSQAVGRSSFYCLEYF PSQMLRTGNNFQFTYTFEDVPFHSSYAHSQSLDRLMNPLI DQYLYYLARTQSNPGGTAGNRELQFYQGGPSTMAEQAKNW LPGPCFRQQRVSKTLDQNNNSNFAWTGATKYHLNGRNSLV NPGVAMATHKDDEDRFFPSSGVLIFGKTGATNKTTLENVL MTNEEEIRPTNPVATEEYGIVSSNLQAANTAAQTQVVNNQ GALPGMVWQNRDVYLQGPIWAKIPHTDGNFHPSPLMGGFG LKHPPPQILIKNTPVPADPPTTFNQSKLNSFITQYSTGQV SVEIEWELQKENSKRWNPEIQYTSNFEKQTGVDFAVNTEG VYSEPRPIGTRYLTRNL |
| Anc110_8VR SEQ ID NO: 151 | Anc110 | AAV8 | VR | MAADGYLPDWLEDNLSEGIREWWDLKPGAPKPKANQQKQD DGRGLVLPGYKYLGPFNGLDKGEPVNAADAAALEHDKAYD QQLKAGDNPYLRYNHADAEFQERLQEDTSFGGNLGRAVFQ AKKRVLEPLGLVEEGAKTAPGKKRPVEQSPQEPDSSSGIG KTGQQPAKKRLNFGQTGDSESVPDPQPLGEPPAAPSGVGS NTMASGGGAPMADNNEGADGVGNSSGNWHCDSTWLGDRVI TTSTRTWALPTYNNHLYKQISNGTSGGATNDNTYFGYSTP |

TABLE 3-continued

| Name/<br>SEQ ID NO: | Backbone<br>Sequence | Donor<br>Sequence | Substitution | VP1 Amino Acid Sequence |
|---|---|---|---|---|
| | | | | WGYFDFNRFHCHFSPRDWQRLINNNWGFRPKRLNFKLFNI<br>QVKEVTQNEGTKTIANNLTSTVQVFTDSEYQLPYVLGSAH<br>QGCLPPFPADVFMIPQYGYLTLNNGSQAVGRSSFYCLEYF<br>PSQMLRTGNNFQFSYTFEDVPFHSSYAHSQSLDRLMNPLI<br>DQYLYFLSRTQTTGGTANTQTLQFSQAGPSSMANQARNWV<br>PGPCYRQQRVSTTTGQNNNSNFAWTAATKYHLNGRDSLMN<br>PGVAMASHKDDEERFFPSNGVLIFGKQNAARDNADYSDVM<br>ITNEEEIKTTNPVATEEYGAVADNLQQQNTAPQIGLVHNQ<br>GVLPGMVWQNRDVYLQGPIWAKIPHTDGNFHPSPLMGGFG<br>LKHPPPQILIKNTPVPADPPTTFNQAKLNSFITQYSTGQV<br>SVEIEWELQKENSKRWNPEIQYTSNYYKSTSVDFAVNTEG<br>VYSEPRPIGTRFLTRNL |
| Anc110_8VRGBS<br>SEQ ID NO: 152 | Anc110 | AAV8 | VRGBS | MAADGYLPDWLEDNLSEGIREWWDLKPGAPKPKANQQKQD<br>DGRGLVLPGYKYLGPFNGLDKGEPVNAADAAALEHDKAYD<br>QQLKAGDNPYLRYNHADAEFQERLQEDTSFGGNLGRAVFQ<br>AKKRVLEPLGLVEEGAKTAPGKKRPVEQSPQEPDSSSGIG<br>KTGQQPAKRLNFGQTGDSESVPDPQPLGEPPAAPSGVGS<br>NTMASGGGAPMADNNEGADGVGNSSGNWHCDSTWLGDRVI<br>TTSTRTWALPTYNNHLYKQISNGTSGGATNDNTYFGYSTP<br>WGYFDFNRFHCHFSPRDWQRLINNNWGFRPKRLNFKLFNI<br>QVKEVTQNEGTKTIANNLTSTVQVFTDSEYQLPYVLGSAH<br>QGCLPPFPADVFMIPQYGYLTLNNGSQAVGRSSFYCLEYF<br>PSQMLRTGNNFQFSYTFEDVPFHSSYAHSQSLDRLMNPLI<br>DQYLYFLSRTQTTGGTANTQTLQFSQGGPNTMANQARNWV<br>PGPCYRQQRVSTTTGQNNNSNFAWTAATKYHLNGRDSLMN<br>PGVAMASHKDDEERFFPSNGVLIFGKQNAARDNADYSDVM<br>ITNEEEIKTTNPVATEEYGAVADNLQQQNTAPQIGLVHNQ<br>GVLPGMVWQNRDVYLQGPIWAKIPHTDGNFHPSPLMGGFG<br>LKHPPPQILIKNTPVPADPPTTFNQAKLNSFITQYSTGQV<br>SVEIEWELQKENSKRWNPEIQYTSNYYKSTSVDFAVNTEG<br>VYSEPRPIGTRFLTRNL |
| AAV7_rh10VR<br>SEQ ID NO: 153 | AAV7 | rh10 | VR | MAADGYLPDWLEDNLSEGIREWWDLKPGAPKPKANQQKQD<br>NGRGLVLPGYKYLGPFNGLDKGEPVNAADAAALEHDKAYD<br>QQLKAGDNPYLRYNHADAEFQERLQEDTSFGGNLGRAVFQ<br>AKKRVLEPLGLVEEGAKTAPAKKRPVEPSPQRSPDSSTGI<br>GKKGQQPARKLNFGQTGDSESVPDPQPLGEPPAAPSSVG<br>SGTVAAGGGAPMADNNEGADGVGNASGNWHCDSTWLGDRV<br>ITTSTRTWALPTYNNHLYKQISNGTSGGSTNDNTYFGYST<br>PWGYFDFNRFHCHFSPRDWQRLINNNWGFRPKKLRFKLFN<br>IQVKEVTQNEGTKTIANNLTSTIQVFSDSEYQLPYVLGSA<br>HQGCLPPFPADVFMIPQYGYLTLNNGSQSVGRSSFYCLEY<br>FPSQMLRTGNNFEFSYSFEDVPFHSSYAHSQSLDRLMNPL<br>IDQYLYYLARTQSTGGTAGTQQLQFYQGGPSTMAEQAKNW<br>LPGPCFRQQRVSTTLSQNNNSNFAWTGATKYHLNGRNSLV<br>NPGVAMATHKDDEERFFPSSGVLIFGKQGAGKDNVDYSSV<br>LMTNEEEIRPTNPVATEEYGIVADNLQQQNAAPIVQVVNN<br>QGALPGMVWQNRDVYLQGPIWAKIPHTDGNFHPSPLMGGF<br>GLKHPPPQILIKNTPVPANPPEVFTPAKFASFITQYSTGQ<br>VSVEIEWELQKENSKRWNPEIQYTSNYYKSTNVDFAVDSQ<br>GVYSEPRPIGTRYLTRNL |
| AAV7_rh10VRGBS<br>SEQ ID NO: 154 | AAV7 | rh10 | VRGBS | MAADGYLPDWLEDNLSEGIREWWDLKPGAPKPKANQQKQD<br>NGRGLVLPGYKYLGPFNGLDKGEPVNAADAAALEHDKAYD<br>QQLKAGDNPYLRYNHADAEFQERLQEDTSFGGNLGRAVFQ<br>AKKRVLEPLGLVEEGAKTAPAKKRPVEPSPQRSPDSSTGI<br>GKKGQQPARKLNFGQTGDSESVPDPQPLGEPPAAPSSVG<br>SGTVAAGGGAPMADNNEGADGVGNASGNWHCDSTWLGDRV<br>ITTSTRTWALPTYNNHLYKQISNGTSGGSTNDNTYFGYST<br>PWGYFDFNRFHCHFSPRDWQRLINNNWGFRPKKLRFKLFN<br>IQVKEVTQNEGTKTIANNLTSTIQVFSDSEYQLPYVLGSA<br>HQGCLPPFPADVFMIPQYGYLTLNNGSQSVGRSSFYCLEY<br>FPSQMLRTGNNFEFSYSFEDVPFHSSYAHSQSLDRLMNPL<br>IDQYLYYLARTQSTGGTAGTQQLQFYQAGPNNMSAQAKNW<br>LPGPCFRQQRVSTTLSQNNNSNFAWTGATKYHLNGRNSLV<br>NPGVAMATHKDDEERFFPSSGVLIFGKQGAGKDNVDYSSV<br>LMTNEEEIRPTNPVATEEYGIVADNLQQQNAAPIVQVVNN<br>QGALPGMVWQNRDVYLQGPIWAKIPHTDGNFHPSPLMGGF<br>GLKHPPPQILIKNTPVPANPPEVFTPAKFASFITQYSTGQ<br>VSVEIEWELQKENSKRWNPEIQYTSNYYKSTNVDFAVDSQ<br>GVYSEPRPIGTRYLTRNL |
| AAV7_rh10VRGH<br>SEQ ID NO: 155 | AAV7 | rh10 | VRGH | MAADGYLPDWLEDNLSEGIREWWDLKPGAPKPKANQQKQD<br>NGRGLVLPGYKYLGPFNGLDKGEPVNAADAAALEHDKAYD<br>QQLKAGDNPYLRYNHADAEFQERLQEDTSFGGNLGRAVFQ<br>AKKRVLEPLGLVEEGAKTAPAKKRPVEPSPQRSPDSSTGI |

TABLE 3-continued

| Name/<br>SEQ ID NO: | Backbone<br>Sequence | Donor<br>Sequence | Substitution | VP1 Amino Acid Sequence |
|---|---|---|---|---|
| | | | | GKKGQQPARKRLNFGQTGDSESVPDPQPLGEPPAAPSSVG<br>SGTVAAGGGAPMADNNEGADGVGNASGNWHCDSTWLGDRV<br>ITTSTRTWALPTYNNHLYKQISNGTSGGSTNDNTYFGYST<br>PWGYFDFNRFHCHFSPRDWQRLINNNWGFRPKKLRFKLFN<br>IQVKEVTQNEGTKTIANNLTSTIQVFSDSEYQLPYVLGSA<br>HQGCLPPFPADVFMIPQYGYLTLNNGSQSVGRSSFYCLEY<br>FPSQMLRTGNNFEFSYSFEDVPFHSSYAHSQSLDRLMNPL<br>IDQYLYYLSRTQSTGGTAGTQQLLFSQAGPNNMSAQAKNW<br>LPGPCYRQQRVSTTLSQNNNSNFAWTGATKYHLNGRDSLV<br>NPGVAMATHKDDEERFFPSSGVLMFGKQGAGKDNVDYSSV<br>MLTSEEEIKTTNPVATEQYGVVADNLQQQNAAPIVGAVNS<br>QGALPGMVWQNRDVYLQGPIWAKIPHTDGNFHPSPLMGGF<br>GLKHPPPQILIKNTPVPANPPEVFTPAKFASFITQYSTGQ<br>VSVEIEWELQKENSKRWNPEIQYTSNYYKSTNVDFAVDSQ<br>GVYSEPRPIGTRYLTRNL |
| AAV9_rh10VRGBS<br>SEQ ID NO: 156 | AAV9 | rh10 | VRGBS | MAADGYLPDWLEDNLSEGIREWWALKPGAPQPKANQQHQD<br>NARGLVLPGYKYLGPGNGLDKGEPVNAADAAALEHDKAYD<br>QQLKAGDNPYLKYNHADAEFQERLKEDTSFGGNLGRAVFQ<br>AKKRLLEPLGLVEEAAKTAPGKKRPVEQSPQEPDSSAGIG<br>KSGAQPAKKRLNFGQTGDTESVPDPQPIGEPPAAPSGVGS<br>LTMASGGGAPVADNNEGADGVGSSSGNWHCDSQWLGDRVI<br>TTSTRTWALPTYNNHLYKQISNGTSGGSTNDNAYFGYSTP<br>WGYFDFNRFHCHFSPRDWQRLINNNWGFRPKRLNFKLFNI<br>QVKEVTQNEGTKTIANNLTSTVQVFTDSDYQLPYVLGSAH<br>EGCLPPFPADVFMIPQYGYLTLNNGSQAVGRSSFYCLEYF<br>PSQMLRTGNNFQFSYEFENVPFHSSYAHSQSLDRLMNPLI<br>DQYLYYLSKTISTGGTAGTQQLKFSVAGPSNMAVQGRNYI<br>PGPSYRQQRVSTTLSQNNNSNFAWTGASSWALNGRNSLMN<br>PGPAMATHKDDEERFFPSSGSLIFGKQGAGKDNVDYSSVM<br>ITNEEEIKTTNPVATESYGQVADNLQQQNAAPIVGWVQNQ<br>GILPGMVWQDRDVYLQGPIWAKIPHTDGNFHPSPLMGGFG<br>MKHPPPQILIKNTPVPADPPTAFNKDKLNSFITQYSTGQV<br>SVEIEWELQKENSKRWNPEIQYTSNYYKSTNVDFAVNTEG<br>VYSEPRPIGTRYLTRNL |
| AAV9_rh10VRGH<br>SEQ ID NO: 157 | AAV9 | rh10 | VRGH | MAADGYLPDWLEDNLSEGIREWWALKPGAPQPKANQQHQD<br>NARGLVLPGYKYLGPGNGLDKGEPVNAADAAALEHDKAYD<br>QQLKAGDNPYLKYNHADAEFQERLKEDTSFGGNLGRAVFQ<br>AKKRLLEPLGLVEEAAKTAPGKKRPVEQSPQEPDSSAGIG<br>KSGAQPAKKRLNFGQTGDTESVPDPQPIGEPPAAPSGVGS<br>LTMASGGGAPVADNNEGADGVGSSSGNWHCDSQWLGDRVI<br>TTSTRTWALPTYNNHLYKQISNGTSGGSTNDNAYFGYSTP<br>WGYFDFNRFHCHFSPRDWQRLINNNWGFRPKRLNFKLFNI<br>QVKEVTQNEGTKTIANNLTSTVQVFTDSDYQLPYVLGSAH<br>EGCLPPFPADVFMIPQYGYLTLNNGSQAVGRSSFYCLEYF<br>PSQMLRTGNNFQFSYEFENVPFHSSYAHSQSLDRLMNPLI<br>DQYLYYLSRTQSTGGTAGTQQLLFSQAGPNNMSAQAKNWL<br>PGPCYRQQRVSTTLSQNNNSNFAWTGATKYHLNGRDSLVN<br>PGVAMATHKDDEERFFPSSGVLMFGKQGAGKDNVDYSSVM<br>LTSEEEIKTTNPVATEQYGVVADNLQQQNAAPIVGAVNSQ<br>GALPGMVWQDRDVYLQGPIWAKIPHTDGNFHPSPLMGGFG<br>MKHPPPQILIKNTPVPADPPTAFNKDKLNSFITQYSTGQV<br>SVEIEWELQKENSKRWNPEIQYTSNYYKSTNVDFAVNTEG<br>VYSEPRPIGTRYLTRNL |

Example 3

Analysis of Engineered Chimeric Capsid Proteins

DNAseI resistant virus titer analysis was used to characterize the virus packaging efficiency and production of engineered AAV variants. Five million HEK293 cells were seeded on a 10 cm cell culture dish and incubated overnight at 37° C. AAV plasmid transfection was performed using a conventional calcium phosphate transfection protocol using ~20 µg total DNA. Cells were harvested at 72 hours post-transfection and centrifuged at 1,000×g for 15 minutes. Lysis buffer was added to the cell pellet and samples were subjected to three freeze-thaw cycles with the addition of DNAseI in the final thaw, followed by an incubation for 30 minutes. Crude expressed AAV virus was collected in the supernatant after centrifugation to remove cellular debris at 10,000×g for 30 minutes. EDTA was added to stop the DNaseI activity and then the expressed AAV was incubated at 95° C. for 15 minutes to further inactivate the DNase. Quantitative PCR was performed using a LightCyclerII according to the Fast Expression Taqman PCR mix protocol provided from the manufacturer (Roche). Virus titers were calculated and compared in vg/µL amounts. Each virus titer measurement was performed 3 times. The results of this DNaseI resistant titer analysis are provided below in Table 4 and are ordered from highest to lowest titer.

TABLE 4

| Crude AAV | AVERAGE | STDEV |
|---|---|---|
| AAV9_rh10VRGBS | 6.60E+08 | 5.32E+07 |
| AAV7_rh10VRGBS | 5.58E+08 | 7.27E+07 |
| AAV7_rh10VR | 4.72E+08 | 1.79E+07 |
| AAV7_rh10VRGH | 4.19E+08 | 3.49E+07 |
| Anc110_8VRGBS | 3.68E+08 | 3.60E+07 |
| AAV9_rh10VRGH | 3.31E+08 | 4.11E+07 |
| AAV8_5VR | 2.47E+08 | 2.72E+07 |
| AAV8 | 2.10E+08 | 8.83E+07 |
| AAV2 | 1.71E+08 | 1.01E+08 |
| AAV8_7VRGBS | 1.58E+08 | 8.57E+06 |
| AAV7 | 1.50E+08 | 5.71E+07 |
| AAV8_6VRGH | 1.20E+08 | 9.65E+06 |
| AAV8_6VR | 1.14E+08 | 1.21E+07 |
| AAV8_6VRGBS | 1.12E+08 | 9.44E+06 |
| AAV8_7VRGH | 1.03E+08 | 1.76E+07 |
| Anc110_5VR | 9.13E+07 | 1.27E+07 |
| AAV9 | 7.63E+07 | 2.64E+07 |
| AAV12 | 6.76E+07 | 3.18E+07 |
| AAVanc110_9VRHS | 6.64E+07 | 5.38E+07 |
| AAVmo_9VRGH | 6.18E+07 | 1.12E+07 |
| AAVanc110_9VR.PHP | 6.06E+07 | 1.37E+07 |
| AAVmo_8VR | 5.04E+07 | 1.09E+07 |
| AAVmo_9VR | 4.11E+07 | 8.80E+06 |
| AAV8_9VRGBS.SmT | 4.07E+07 | 2.11E+07 |
| AAV4_9GH | 3.97E+07 | 6.45E+06 |
| AAVmo_9GH | 3.67E+07 | 6.29E+06 |
| AAVbo_8VRGH | 3.49E+07 | 1.12E+07 |
| AAVmol_WT | 3.34E+07 | 7.17E+06 |
| AAV4_2GH | 3.21E+07 | 1.06E+07 |
| AAV4_8VR | 3.16E+07 | 4.68E+06 |
| AAVanc110_9GH.PHP | 3.12E+07 | 4.10E+06 |
| AAVmo_8VRGH | 3.11E+07 | 1.10E+07 |
| AAVbo_9VR | 2.97E+07 | 1.20E+07 |
| AAV4_8GH | 2.90E+07 | 3.48E+06 |
| AAVrh10 | 2.88E+07 | 5.51E+06 |
| AAVanc110_9VR | 2.76E+07 | 4.72E+06 |
| AAV4_9VRGH | 2.68E+07 | 3.75E+06 |
| AAV4_2VR | 2.32E+07 | 6.96E+06 |
| AAV8_6VRGH | 2.32E+07 | 4.88E+06 |
| AAV4_8VRGH | 2.26E+07 | 2.97E+06 |
| AAV4_2VRGH | 2.17E+07 | 5.87E+06 |
| AAVanc110_9GH | 2.13E+07 | 1.16E+07 |
| AAVmo_8GH | 2.13E+07 | 6.34E+06 |
| AAVbo_8VR | 2.12E+07 | 2.84E+06 |
| AAV4 | 2.04E+07 | 5.02E+06 |
| AAV8_9VRGBS | 2.02E+07 | 6.82E+06 |
| AAV6.2_9GH | 1.93E+07 | 4.25E+06 |
| AAVmo_2VRGH | 1.69E+07 | 3.95E+06 |
| AAV6 | 1.67E+07 | 3.40E+06 |
| AAV5 | 1.64E+07 | 2.35E+06 |
| AAV8_anc110GH | 1.54E+07 | 2.82E+06 |
| AAV6.2_9VRGBS | 1.50E+07 | 3.92E+06 |
| AAVbo_WT | 1.38E+07 | 1.49E+07 |
| AAV8_9VRGBS.MK | 1.25E+07 | 6.73E+06 |
| AAV8_9VRGBS.PA | 1.12E+07 | 3.51E+06 |
| AAV8_6VRGBS | 9.42E+06 | 5.27E+06 |
| AAVbo_9GH | 9.35E+06 | 6.75E+06 |
| AAV7_9VRGBS | 9.14E+06 | 2.24E+06 |
| AAVmo_2VR | 8.83E+06 | 3.08E+06 |
| AAV8_9RGBS.SA | 8.65E+06 | 2.21E+06 |
| AAV8_9RGBS.ST | 8.20E+06 | 5.97E+06 |
| AAV8_6VR | 7.76E+06 | 3.65E+06 |
| AAV8_9VRGBS.MI | 7.72E+06 | 1.59E+05 |
| AAV8_9VRGBS.PHP | 7.55E+06 | 2.52E+06 |
| AAVanc110 | 7.05E+06 | 2.26E+06 |
| AAV8_9VRGBS.MA | 5.36E+06 | 5.02E+05 |
| AAVanc110_9VRGBS | 5.36E+06 | 1.12E+06 |
| AAVrh10_9GH | 5.13E+06 | 7.73E+05 |
| AAVanc110_8VR | 4.77E+06 | 1.60E+06 |
| AAVanc110_8GH | 4.64E+06 | 1.32E+06 |
| AAVanc80L65 | 4.07E+06 | 3.85E+05 |
| AAV8_9VRGH.PHP | 3.66E+06 | 2.33E+06 |
| AAVbo_8GH | 2.80E+06 | 8.36E+05 |
| AAV4_9VR | 2.14E+06 | N/A |
| AAV9_anc110VR | 1.65E+06 | 3.58E+05 |
| AAV8_9VRGH | 1.48E+06 | 2.37E+05 |
| AAV8_anc110VR | 1.21E+06 | 4.89E+05 |
| AAV9_anc110GH | 1.19E+06 | 3.07E+05 |
| Bce36_9GH | 8.44E+05 | 1.96E+05 |
| No Cap Control | 5.03E+05 | 3.81E+04 |
| AAVbo_9VRGH | 1.13E+05 | 7.52E+03 |

The results in Table 4 demonstrate that AAV virus comprising the engineered chimeric AAV capsids of the present invention may be successfully produced, although with varying titers.

Next, the ability of AAV particles comprising engineered chimeric capsid proteins of the present invention to transduce cultured cells in vitro was determined. HEK293 and HepG2 cells were seeded at $5\times10^4$ cells/well on a 96 well plate and incubated overnight. Etoposide was added on the day of infection to a final concentration of 4 μM and 20 μM for HEK293 and HepG2 cells, respectively. Different crude AAV particles were added at an MOI of 2000 and transduction data was measured in relative luciferase units (RLU) 72 hours post-infection. The efficiency of transduction data is provided in Table 5 below and is ordered from the highest to the lowest transduction ability. As expected, recombinant AAV2 (positive control) exhibited the best in vitro transduction for both cell lines and most of the engineered chimeric AAVs tested were shown to have positive (RLU>$10^4$) in vitro transduction properties. These results demonstrate that not only may AAV particles comprising the chimeric engineered capsid proteins of the present invention be successfully produced, but those novel recombinant AAV particles are functional in that they are capable of transducing either HEK293 or HepG2 cells with varying efficiencies.

TABLE 5

| AAV | AVRG | ERROR |
|---|---|---|
| HEK293 | | |
| AAV2 | 9.07E+06 | 8.54E+05 |
| AAVBce36 | 2.11E+05 | 7.57E+04 |
| AAV7 | 1.60E+05 | 6.77E+04 |
| AAV8_9VRGBS | 1.06E+05 | 6.65E+03 |
| AAV8_anc110GH | 9.45E+04 | 8.35E+03 |
| AAVanc110 | 7.89E+04 | 6.14E+04 |
| AAVanc110_8GH | 6.96E+04 | 1.01E+04 |
| AAV5 | 6.33E+04 | 4.82E+03 |
| AAVboWT | 5.90E+04 | 4.36E+03 |
| AAV9 | 3.85E+04 | 3.93E+03 |
| AAV8_9VRGBS.ST | 2.96E+04 | 4.45E+03 |
| AAV8 | 2.93E+04 | 1.80E+03 |
| AAV6.2_9GH | 2.61E+04 | 4.71E+03 |
| AAV8_9VRGH.PHP | 2.45E+04 | 1.43E+04 |
| AAV8_9VRGBS.PA | 1.64E+04 | 5.58E+03 |
| AAV6 | 1.64E+04 | 2.29E+03 |
| AAVanc110_9VR | 1.49E+04 | 3.33E+03 |
| AAV8_9VRGBS.SA | 1.37E+04 | 1.65E+03 |
| rh10 | 1.09E+04 | 1.79E+03 |
| AAVanc110_9VRHS | 1.02E+04 | 2.26E+03 |
| AAVanc110_8VR | 9.67E+03 | 1.76E+03 |
| AAV8_9VRGBS.MI | 7.13E+03 | 3.07E+03 |
| AAV12 | 5.93E+03 | 1.97E+03 |
| AAV8_9VRGBS.PHP | 5.70E+03 | 3.59E+03 |
| AAV9_anc110VR | 5.42E+03 | 4.20E+03 |
| AAV8_9VRGH | 5.24E+03 | 4.99E+02 |
| AAVanc110_9VRGBS | 3.77E+03 | 2.09E+03 |
| AAV8_anc110VR | 3.22E+03 | 4.17E+03 |
| AAV9_anc110GH | 2.57E+03 | 1.81E+03 |
| AAV7_rh10VRGH | 1.70E+03 | 3.44E+02 |
| AAVanc110_9GH | 1.51E+03 | 9.65E+01 |
| AAVbo_9GH | 1.01E+03 | 9.05E+01 |
| AAV_Anc110 | 9.61E+02 | 1.78E+02 |
| AAVmo_9VRGH | 7.29E+02 | 3.87E+02 |

TABLE 5-continued

| AAV | AVRG | ERROR |
|---|---|---|
| AAVanc110_9VR.PHP | 6.95E+02 | 8.71E+02 |
| no Cap control | 6.85E+02 | 7.13E+01 |
| AAVrh10_9VRGBS | 6.55E+02 | 6.87E+02 |
| AAV8_7VRGH | 4.93E+02 | 4.72E+02 |
| AAV7_9GH | 4.93E+02 | 1.35E+02 |
| AAV8_9VRGBS.MA | 4.91E+02 | 4.35E+01 |
| AAV8_6VR | 4.52E+02 | 1.22E+02 |
| AAV4_2VR | 4.06E+02 | 2.40E+02 |
| AAV9_rh10VRGH | 3.94E+02 | 1.44E+02 |
| Neg | 3.19E+02 | 7.49E+01 |
| AAV4_2GH | 3.04E+02 | 5.38E+01 |
| Anc110_8VRGBS | 3.02E+02 | 5.09E+01 |
| AAV4_8VRGH | 2.69E+02 | 2.62E+01 |
| AAV8_9VRGBS.MK | 2.53E+02 | 1.10E+01 |
| AAVanc110_9GH.PHP | 2.49E+02 | 9.90E+01 |
| AAV4_2VRGH | 2.49E+02 | 1.03E+02 |
| AAVmo_8GH | 2.49E+02 | 2.25E+01 |
| AAV4_8GH | 2.34E+02 | 6.31E+01 |
| AAVmo_9GH | 2.28E+02 | 5.11E+01 |
| AAVBce36_9VRGBS | 2.06E+02 | 1.55E+02 |
| AAVmo_8VRGH | 1.92E+02 | 1.36E+01 |
| AAV9_rh10VRGBS | 1.62E+02 | 9.99E+00 |
| AAVmo_8VR | 1.60E+02 | 3.38E+01 |
| AAVBce41_8VRGBS | 1.58E+02 | 5.01E+01 |
| AAV4_9VRGH | 1.52E+02 | 1.21E+01 |
| Anc110_5VR | 1.49E+02 | 5.87E+00 |
| AAVbo_9VR | 1.37E+02 | 1.21E+01 |
| AAV4_9GH | 1.33E+02 | 9.27E+00 |
| AAV8_7VRGBS | 1.29E+02 | 1.04E+01 |
| AAV8_7VRGH | 1.29E+02 | 2.00E+01 |
| AAV4_8VR | 1.25E+02 | 8.36E+00 |
| AAVbo_8VR | 1.22E+02 | 2.00E+01 |
| AAVmo_9VR | 1.21E+02 | 1.09E+01 |
| AAVbo_8VRGH | 1.21E+02 | 1.31E+01 |
| AAV8_5VR | 1.11E+02 | 1.94E+01 |
| AAV7_rh10VR | 1.10E+02 | 1.28E+01 |
| AAV8_6VRGBS | 9.60E+01 | 7.39E+00 |
| AAV6.2_9VRGBS | 9.53E+01 | 1.22E+01 |
| AAV7_rh10VRGBS | 8.40E+01 | 3.46E+00 |
| AAV8_6VRGH | 7.84E+01 | 5.62E+00 |
| HepG2 | | |
| AAV2 | 2.12E+07 | 1.59E+06 |
| AAV9_anc110VR | 2.41E+06 | 2.01E+05 |
| AAV8_anc110GH | 6.50E+05 | 3.64E+03 |
| AAV8_9VRGBS | 6.14E+05 | 8.37E+03 |
| AAVanc110_8GH | 6.07E+05 | 5.75E+04 |
| AAV9 | 4.14E+05 | 3.22E+03 |
| AAV8_anc110VR | 2.76E+05 | 5.89E+04 |
| AAV5 | 2.33E+05 | 3.16E+03 |
| AAVBce36 | 1.28E+05 | 4.46E+04 |
| AAV7 | 9.96E+04 | 4.20E+04 |
| AAVanc110_8VR | 7.26E+04 | 3.83E+03 |
| AAV9_anc110GH | 6.36E+04 | 1.45E+04 |
| rh10 | 5.83E+04 | 1.63E+03 |
| AAV6 | 4.13E+04 | 4.44E+03 |
| AAV8_9VRGH.PHP | 3.89E+04 | 2.22E+04 |
| AAV8 | 3.54E+04 | 4.86E+03 |
| AAVanc110_9VR | 3.35E+04 | 3.91E+03 |
| AAVanc110 | 3.18E+04 | 2.32E+04 |
| AAVanc110_9GH | 2.42E+04 | 5.33E+02 |
| AAV7_rh10VRGH | 8.44E+03 | 7.72E+02 |
| AAV_Anc110 | 8.14E+03 | 5.22E+01 |
| AAV8_9VRGBS.PHP | 4.19E+03 | 2.47E+03 |
| AAV8_6VR | 3.87E+03 | 8.42E+02 |
| AAVanc110_9VR.PHP | 2.66E+03 | 3.94E+02 |
| AAVboWT | 2.58E+03 | 8.17E+02 |
| no Cap control | 2.18E+03 | 3.70E+02 |
| AAV4_2GH | 1.61E+03 | 6.60E+02 |
| AAVbo_9GH | 1.58E+03 | 6.33E+02 |
| Anc110_8VRGBS | 1.45E+03 | 4.08E+02 |
| AAV9_rh10VRGH | 1.30E+03 | 2.03E+02 |
| AAV9_rh10VRGBS | 1.26E+03 | 1.10E+02 |
| AAVrh10_9VRGBS | 7.92E+02 | 6.42E+02 |
| AAVanc110_9GH.PHP | 6.78E+02 | 2.18E+02 |
| AAV8_7VRGH | 5.35E+02 | 1.13E+02 |
| AAV4_2VRGH | 4.85E+02 | 3.04E+02 |
| AAVmo_8GH | 4.71E+02 | 1.01E+02 |
| AAVmo_9GH | 3.92E+02 | 9.89E+01 |
| AAV4_9VRGH | 3.76E+02 | 1.07E+02 |
| AAV4_8VRGH | 3.10E+02 | 1.40E+01 |
| AAV7_9GH | 3.01E+02 | 9.52E+01 |
| AAV4_2VR | 2.83E+02 | 8.36E+00 |
| AAV8_6VRGBS | 2.63E+02 | 5.38E+01 |
| AAVmo_8VRGH | 2.52E+02 | 1.48E+01 |
| AAVBce36_9VRGBS | 2.44E+02 | 2.03E+02 |
| AAVBce41_8VRGBS | 2.33E+02 | 5.34E+01 |
| AAV4_9GH | 2.10E+02 | 3.50E+01 |
| AAV4_8VR | 1.97E+02 | 1.38E+01 |
| AAV4_8GH | 1.89E+02 | 2.26E+01 |
| AAV8_7VRGBS | 1.86E+02 | 5.92E+01 |
| AAVbo_8VR | 1.57E+02 | 6.67E-01 |
| AAVmo_8VR | 1.53E+02 | 5.21E+00 |
| AAVbo_9VR | 1.43E+02 | 1.07E+01 |
| AAVmo_9VRGH | 1.39E+02 | 6.77E+00 |
| AAVbo_8VRGH | 1.32E+02 | 1.04E+01 |
| AAVmo_9VR | 1.26E+02 | 1.62E+01 |
| Anc110_5VR | 1.05E+02 | 1.51E+01 |
| AAV8_5VR | 8.55E+01 | 1.64E+01 |
| AAV7_rh10VR | 6.67E+01 | 2.38E+01 |
| AAV7_rh10VRGBS | 5.13E+01 | 8.74E+00 |
| AAV8_6VRGH | 4.75E+01 | 1.11E+01 |

Next, the ability of the certain engineered AAV particles of the present invention to transduce glial cells was investigated. Human glioblastoma U87MG cells were seeded at $5 \times 10^4$ cells/well on a 96 well plate and incubated overnight. Etoposide was added on the day of infection to a final concentration of 4 µM. Different crude AAV particles were added at an MOI of 2000 and transduction data was measured in RLU units 72 hours post-infection. As shown in Table 6, engineered AAV variants retained the ability to transduce glial cells with various efficiencies.

TABLE 6

U87MG glial cell transduction data:

| AAV | AVERAGE | ERROR |
|---|---|---|
| AAV2 | 3.89E+06 | 5.32E+05 |
| AAV8_9VRGBS | 1.34E+05 | 1.74E+04 |
| AAV5 | 9.51E+04 | 1.26E+04 |
| AAV8_anc110GH | 6.05E+04 | 8.85E+03 |
| AAV9 | 2.52E+04 | 1.68E+03 |
| anc110_9VR | 1.05E+04 | 1.47E+03 |
| anc110_9VR.PHP | 2.53E+03 | 5.81E+02 |
| AAVanc110_8VR | 1.38E+03 | 5.67E+01 |
| anc110_9GH | 1.19E+03 | 3.05E+02 |
| anc110_9GH.PHP | 9.22E+02 | 2.39E+01 |
| anc110_8GH | 4.55E+02 | 1.57E+01 |

Neutralization of the engineered AAV particles of the present invention by antibodies in human serum was also investigated. HEK293T cells were seeded in density $5 \times 10^4$ cells/well and incubated overnight. Purified rAAVs were diluted to final titer of $2 \times 10^6$ vg/uL and mixed with serial dilutions (0-10 mg/mL) of IVIG for 1 hour. Recombinant AAVs were added onto HEK293T cells using MOI of 1000 and incubated in 37° C. Seventy-two hours post-infection, IVIG neutralization was analyzed based on relative luciferase unit (RLU) reading. No etoposide was used in this study. The results are provided in Table 7. As expected, AAV2 transduction (positive control) was abolished by the addition of human IVIG. In contrast, certain of the engineered AAVs tested exhibited IVIG resistant properties.

TABLE 7

| IVIG Neutralization Data: | | | | | | | | | | |
|---|---|---|---|---|---|---|---|---|---|---|
| IVIG (mg/ml) | 10 | 5 | 2.5 | 1.25 | 0.625 | 0.312 | 0.156 | 0.0781 | 0.039 | 0.01 |
| AAV2 | 44 | 55 | 46 | 65 | 73 | 76 | 1351 | 11462 | 71835 | 681882 |
| AAV5 | 60 | 56 | 46 | 39 | 725 | 4872 | 9210 | 12821 | 14065 | 14154 |
| AAV8 | 29 | 45 | 49 | 39 | 139 | 2029 | 13742 | 32098 | 49373 | 66066 |
| AAV9 | 27 | 40 | 53 | 59 | 45 | 444 | 1462 | 6820 | 13934 | 23233 |
| AAVrh10 | 45 | 37 | 59 | 39 | 31 | 537 | 3429 | 13190 | 25726 | 34653 |
| Bce36 | 32 | 41 | 18 | 78 | 64 | 340 | 3398 | 21732 | 39388 | 64691 |
| AAV8_9VRGBS | 57 | 46 | 36 | 42 | 60 | 236 | 1966 | 7223 | 12080 | 20501 |
| AAVanc100_9VR | 44 | 55 | 57 | 40 | 45 | 126 | 363 | 1473 | 2161 | 3462 |
| Bce41 | 36 | 33 | 47 | 44 | 58 | 643 | 3644 | 10161 | 15275 | 25008 |
| Bba41 | 40 | 38 | 55 | 47 | 45 | 57 | 1096 | 4459 | 6661 | 8308 |
| Bba42 | 27 | 17 | 32 | 31 | 47 | 42 | 260 | 2125 | 2964 | 4203 |
| Bba43 | 44 | 35 | 42 | 36 | 28 | 288 | 2130 | 6457 | 12626 | 18284 |
| AAV6.2-9GH | 26 | 35 | 45 | 37 | 39 | 82 | 159 | 2691 | 12087 | 38922 |
| AAV8-9VRGH | 39 | 31 | 37 | 39 | 38 | 110 | 1408 | 6235 | 10488 | 16625 |
| AAV7 | 38 | 44 | 26 | 44 | 58 | 276 | 500 | 2891 | 5432 | 10224 |
| AAV6 | 47 | 39 | 103 | 206 | 81 | 101 | 577 | 2319 | 5734 | 9976 |
| AAVBba30 | 32 | 34 | 34 | 57 | 48 | 45 | 349 | 1688 | 3335 | 6203 |
| AAVanc110 | 42 | 39 | 14 | 43 | 36 | 105 | 462 | 1354 | 2822 | 4005 |
| AAVanc110-9VRGBS | 29 | 37 | 35 | 39 | 48 | 39 | 172 | 819 | 2172 | 2922 |

Some of the engineered AAV particles have their GBS region substituted with a GBS region donated from a different AAV capsid sequence. The effect of this substitution on glycan binding properties was investigated. For example, galactose binding was investigated in an engineered AAV variant having the AAV8 backbone sequence with a substitution of all of the variable regions (VR I through VR IX) plus the GBS region from AAV9 (AAV8_9VRGBS). Pro5, Lec1 and Lec2 cells were seeded at $5\times10^4$ cells/well on a 96 well plate and incubated overnight, then chilled at 4° C. for 30 minutes prior to infection. Recombinant AAV particles were added at an MOI of 10,000 and incubated at 4° C. for another 2 hours. After two washes with DMEM media, cells were incubated at 37° C. in DMEM, 10% fetal calf sera for 48 hours and RLU were measured. As shown in Table 8, this particular engineered AAV variant exhibited the ability to bind to Lec2, similar to wild type AAV9, demonstrating that the glycan binding properties of an AAV virus comprising an engineered chimeric AAV capsid protein of the present invention are determined by the donor source of the GBS region swapped into the backbone sequence.

TABLE 8

| Glycan Binding Data | | | | | | |
|---|---|---|---|---|---|---|
| | Pro5 (sialic acid) | | Lec1 (mannose) | | Lec2 (galactose) | |
| | AVERAGE | STDEV | AVERAGE | STDEV | AVERAGE | STDEV |
| AAV9 | 4.21E+03 | 1.76E+03 | 3.56E+03 | 6.82E+02 | 1.22E+05 | 2.90E+04 |
| AAV8_9VRGH | 3.11E+03 | 9.29E+02 | 1.79E+03 | 4.04E+02 | 1.19E+05 | 2.34E+04 |
| AAV8_9VRGBS | 3.72E+03 | 7.71E+02 | 3.36E+03 | 1.14E+03 | 1.09E+05 | 4.21E+04 |
| AAV6.2_9GH | 5.58E+02 | 1.06E+02 | 1.90E+02 | 7.55E+01 | 7.70E+04 | 2.11E+04 |
| AAVanc110_9VRGBS | 4.26E+02 | 1.05E+02 | 3.71E+02 | 6.52E+01 | 2.67E+04 | 7.26E+03 |
| AAV8 | 4.74E+03 | 1.46E+03 | 6.37E+03 | 4.70E+03 | 1.34E+04 | 7.21E+03 |
| AAVBce41 | 8.79E+03 | 2.50E+03 | 4.74E+03 | 2.17E+03 | 8.20E+03 | 2.20E+03 |
| AAVanc110 | 1.48E+03 | 7.36E+02 | 6.61E+02 | 2.88E+02 | 2.25E+03 | 2.32E+02 |
| AAVBce36 | 1.24E+03 | 3.10E+02 | 2.15E+03 | 1.60E+03 | 1.52E+03 | 1.92E+02 |
| AAV7 | 2.57E+02 | 8.02E+01 | 3.66E+02 | 2.08E+02 | 6.10E+02 | 2.67E+02 |
| AAVanc110_9VR | 3.37E+02 | 9.74E+01 | 2.85E+02 | 6.08E+01 | 5.77E+02 | 2.20E+02 |
| AAV6 | 3.91E+03 | 1.18E+03 | 4.12E+02 | 1.75E+02 | 5.62E+02 | 7.22E+01 |
| AAVanc110_9GH | 4.25E+01 | 7.55E+00 | 4.05E+01 | 1.34E+01 | 1.64E+02 | 1.26E+02 |
| AAVBba43 | 5.20E+01 | 1.34E+01 | 5.45E+01 | 8.70E+00 | 1.31E+02 | 5.94E+01 |
| AAV5 | 3.66E+04 | 3.45E+03 | 1.84E+02 | 5.09E+01 | 1.28E+02 | 3.07E+01 |
| AAVBba42 | 7.30E+01 | 1.37E+01 | 6.00E+01 | 2.16E+01 | 1.16E+02 | 2.03E+01 |
| AAVBba41 | 7.25E+01 | 1.33E+01 | 5.55E+01 | 8.54E+00 | 9.60E+01 | 3.07E+01 |
| AAVBba30 | 9.35E+01 | 7.24E+01 | 8.50E+01 | 4.56E+01 | 4.75E+01 | 1.70E+01 |

In order to determine the tissue specific infectivity of the AAV capsids disclosed herein, AAV comprising each of the capsids and expressing the luciferase transgene were generated (AAV-RSV-egfp-T2A-Fluc2). Male Balb/C mice were purchased from Charles River Breeding Laboratories. A dose of $2\times10^{13}$ vg/kg of AAV-RSV-egfp-T2A-Fluc2 vector was injected into the tail vein of 8 week old mice. At 3 and 5 weeks post injection, in vivo bioluminescent imaging was performed using an in vivo imagining device (IVIS Lumina LT obtained from PerkinElmer Inc., Waltham, Mass.). In brief, the mice were anesthetized with 2% isofluorane and oxygen. 150 μl of 30 mg/ml of RediJect D-Luciferin Bioluminescent Substrate was injected intraperitoneally. Ten minutes after substrate injection, the animals were imaged with the in vivo imaging device using its cooled charge-coupled device (CCD) camera. Images were takes in the dorsal positions of the animals. Anesthesia was maintained throughout the entire imaging session by isofluorane-oxygen delivery in the light-tight imaging chamber.

The mice were sacrificed after the imaging sessions at 5 weeks post AAV injection. Various organs were harvested and imaged using the imaging device. The measurement conditions were the same as those used for in vivo imaging.

For imaging, a gray-scale photograph of the animals was acquired, followed by bioluminescence image acquisition. Image data was processed and analyzed using living image software version 4.5.2 (PerkinsElmer Waltham, Mass.). Regions of interest (ROIs) were traced surrounding each animal as well as individual organs to quantify the total flux (TF) (photons/second) being released by luciferase activity. Total flux activity is a proxy for AAV infectivity of each organ system and is shown for each AAV capsid in Table 9. To further characterize the tissue specific infectivity imparted by various capsids, tissue from infected mice was harvested and sectioned. The percent of cells expressing GFP was quantitated for each (see Table 10). These data show that AVV harboring specific capsids and chimeric capsids demonstrate different tissue specificities, for example some AAV are more active in liver while others are more active in muscle tissue. In particular, the data demonstrate that capsids AAVanc110_9VR and Bba41 produce recombinant AAV that have a high degree of specificity for muscle cells. Accordingly, recombinant AAV comprising capsid AAVanc110_9VR or capsid Bba41 would be useful for targeted transgene delivery to muscle cells.

TABLE 9

Total Flux in Tissue (photons/sec/cm$^2$/radian): presented as AVE/(STD)

| Capsid | Brain | Lung | Heart | Liver | Spleen | Kidney | Gast.* | Quad. ** | Front Limb |
|---|---|---|---|---|---|---|---|---|---|
| AAV5 | 2.14E+04 | 9.41E+05 | 9.57E+03 | 2.75E+06 | 2.63E+03 | 1.11E+04 | 2.38E+04 | 1.12E+04 | 1.45E+03 |
|  | (5.75E+03) | (4.50E+05) | (2.80E+03) | (6.58E+05) | (1.94E+03) | (1.75E+03) | (1.44E+04) | (7.74E+03) | (6.40E+02) |
| AAV8 | 2.31E+06 | 4.83E+06 | 6.57E+06 | 4.58E+08 | 7.34E+05 | 2.63E+06 | 6.87E+06 | 9.25E+06 | 1.91E+05 |
|  | (7.88E+05) | (2.34E+06) | (1.71E+06) | (1.82E+08) | (2.84E+05) | (5.58E+05) | (4.71E+06) | (4.83E+06) | (1.55E+04) |
| AAV9 | 2.35E+06 | 2.21E+06 | 1.71E+07 | 1.75E+08 | 5.57E+05 | 1.54E+06 | 4.59E+07 | 4.63E+07 | 2.58E+06 |
|  | (4.35E+05) | (7.75E+05) | (4.45E+06) | (4.65E+07) | (2.64E+05) | (8.70E+05) | (4.75E+07) | (2.21 E+07) | (2.10E+06) |
| AAV8_9VRGBS | 8.18E+05 | 2.02E+06 | 2.75E+06 | 1.80E+08 | 1.79E+05 | 8.84E+05 | 1.49E+06 | 1.46E+06 | 1.00E+05 |
|  | (2.02E+05) | (1.58E+06) | (6.56E+05) | (3.48E+07) | (1.56E+04) | (1.70E+05) | (5.65E+05) | (1.07E+05) | (5.20E+04) |
| Anc110_9VR | 1.87E+06 | 7.79E+05 | 1.28E+07 | 1.80E+07 | 5.83E+05 | 9.34E+05 | 1.72E+08 | 8.88E+07 | 2.69E+06 |
|  | (1.68E+06) | (2.73E+05) | (4.54E+06) | (4.25E+06) | (7.37E+05) | (5.53E+05 | (1.84E+08) | (6.55E+07) | (1.74E+06) |
| Anc110_9GH | 6.22E+03 | 1.07E+04 | 5.56E+03 | 3.62E+05 | 5.75E+03 | 1.07E+04 | 1.57E+04 | 8.06E+03 | 3.96E+03 |
|  | (2.26E+03) | (3.30E+03) | (2.25E+03) | (1.87E+05) | (2.01E+03) | (2.49E+03) | (1.86E+04) | (2.92E+03) | (1.25E+03) |
| Anc110_9VRGBS | 9.71E+04 | 2.644E+05 | 2.75E+06 | 1.30E+07 | 2.91E+04 | 4.50E+05 | 1.95E+07 | 2.17E+07 | 5.64E+05 |
|  | (2.92E+04) | (8.05E+04) | (1.55E+06) | (3.93E+06) | (2.52E+03) | (1.12E+05) | (1.77E+07) | (1.23E+07) | (3.67E+05) |
| AAV6 | 5.72E+03 | 6.60E+04 | 7.61E+04 | 9.23E+06 | 4.98E+03 | 1.87E+04 | 1.68E+04 | 3.19E+04 | 1.72E+03 |
|  | (3.77E+03) | (4.18E+04) | (3.87E+04) | (5.37E+06) | (4.23E+03) | (1.14E+04) | (2.82E+04) | (4.26E+04) | (2.34E+03) |
| AAVanc110 | 1.12E+05 | 9.13E+05 | 5.18E+05 | 1.50E+08 | 1.14E+05 | 5.25E+05 | 2.31E+05 | 3.34E+05 | 1.65E+04 |
|  | (3.58E+04) | (3.58E+05) | (3.01E+05) | (5.98E+07) | (2.32E+04) | (1.86E+05) | (1.02E+05) | (1.80E+05) | (1.16E+04) |
| AAV6.2_9GH | 3.20E+05 | 9.94E+05 | 1.41E+07 | 5.63E+07 | 9.32E+04 | 1.21E+06 | 9.56E+07 | 6.96E+07 | 1.46E+06 |
|  | (1.59E+05) | (3.22E+05) | (4.99E+06) | (1.66E+07) | (3.59E+04) | (3.78E+05) | (7.74E+07) | (2.16E+07) | (6.74E+05) |
| AAV8_9VRGH | 9.10E+04 | 1.32E+06 | 7.74E+05 | 2.02E+08 | 1.36E+05 | 5.88E+05 | 5.33E+05 | 1.02E+06 | 4.86E+04 |
|  | (3.29E+04) | (5.46E+05) | (6.25E+05) | (6.00E+07) | (5.76E+04) | (9.00E+04) | (4.37E+05) | (8.28E+05) | (3.59E+04) |
| AAV7 | 1.47E+05 | 1.03E+06 | 8.04E+05 | 1.47E+08 | 1.47E+05 | 1.13E+06 | 7.04E+05 | 6.52E+05 | 4.42E+04 |
|  | (1.16E+05) | (7.65E+05) | (5.40E+05) | (6.17E+07) | (3.72E+04) | (1.10E+06) | (4.48E+05) | (4.34E+05) | (2.04E+04) |
| AAVBce36 | 1.58E+05 | 3.55E+05 | 1.35E+06 | 1.53E+08 | 4.15E+05 | 3.77E+05 | 4.06E+05 | 7.02E+05 | 1.76E+04 |
|  | (1.31E+04) | (5.40E+04) | (6.18E+05) | (5.03E+06) | (1.13E+05) | (8.99E+04) | (2.02E+05) | (6.58E+05) | (1.91E+04) |
| AAVBce41 | 1.07E+05 | 3.92E+05 | 7.54E+05 | 1.49E+08 | 5.79E+05 | 5.35E+05 | 3.32E+06 | 1.64E+06 | 5.18E+04 |
|  | (4.06E+04) | (4.13E+04) | (6.44E+04) | (5.00E+06) | (2.54E+05) | (4.75E+05) | (4.62E+06) | (5.94E+05) | (3.47E+04) |
| AAVBba41 | 2.43E+05 | 3.75E+05 | 9.63E+06 | 1.36E+07 | 6.70E+04 | 9.90E+05 | 1.79E+08 | 2.32E+08 | 3.62E+06 |
|  | (1.67E+05) | (1.73E+05) | (1.65E+06) | (5.13E+06) | (3.89E+04) | (3.93E+05) | (8.15E+07) | (2.25E+07) | (1.34E+06) |
| AAVBba42 | 2.17E+05 | 4.35E+05 | 9.54E+06 | 1.65E+07 | 5.23E+04 | 1.12E+06 | 2.68E+08 | 1.62E+08 | 4.94E+06 |
|  | (2.10E+04) | (4.16E+05) | (8.14E+05) | (7.75E+06) | (1.76E+04) | (4.41E+05) | (2.35E+08) | (2.70E+07) | (1.99E+06) |
| AAVBba43 | 1.50E+05 | 4.11E+05 | 7.41E+06 | 2.00E+07 | 5.17E+04 | 7.45E+05 | 3.90E+07 | 6.60E+07 | 8.51E+05 |
|  | (7.00E+04) | (1.98E+05) | (3.12E+06) | (3.64E+06) | (3.20E+04) | (1.86E+05) | (1.04E+07) | (3.12E+07) | (4.08E+05) |
| AAVBba30 | 1.10E+05 | 4.74E+05 | 3.10E+06 | 1.24E+07 | 1.99E+04 | 5.18E+05 | 2.00E+07 | 2.38E+07 | 5.77E+05 |
|  | (6.96E+04) | (2.55E+05) | (1.43E+06) | (3.66E+06) | (1.00E+04) | (9.89E+04) | (8.52E+06) | (7.17E+06) | (2.65E+05) |
| AAV12 | 5.08E+03 | 1.72E+05 | 1.74E+04 | 4.17E+06 | 1.44E+03 | 2.22E+04 | 2.48E+05 | 6.63E+05 | 2.02E+04 |
|  | (3.05E+03) | (8.26E+04) | (1.86E+03) | (1.29E+06) | (9.26E+02) | (1.56E+04) | (1.45E+05) | (1.90E+05) | (6.39E+04) |
| AAVBba33 | 1.86E+04 | 2.20E+06 | 2.37E+04 | 1.18E+07 | 2.65E+04 | 3.56E+04 | 2.79E+04 | 1.22E+04 | 7.75E+03 |
|  | (1.11E+04) | (1.20E+06) | (1.35E+04) | (5.28E+06) | (1.36E+04) | (1.80E+04) | (3.18E+04) | (6.27E+03) | (8.64E+03) |
| AAVBba26 | 8.00E+02 | 7.41E+03 | 2.17E+04 | 2.51E+04 | 8.10E+02 | 2.28E+03 | 7.38E+04 | 8.65E+04 | 9.35E+03 |
|  | (2.33E+03) | (6.31E+03) | (1.18E+04) | (7.43E+03) | (1.82E+03) | (2.27E+03) | (4.11E+04) | (6.90E+04) | (4.67E+03) |
| AAVBba44 | 1.41E+04 | 8.76E+04 | 5.29E+05 | 8.05E+05 | 6.90E+03 | 1.05E+05 | 2.17E+06 | 1.94E+06 | 6.40E+04 |
|  | (1.05E+04) | (4.40E+04) | (2.87E+05) | (4.43E+05) | (8.53E+03) | (1.11E+05) | (1.47E+06) | (1.63E+06) | (3.60E+04) |
| AAVrh10 | 4.47E+04 | 1.29E+05 | 1.90E+05 | 6.84E+07 | 4.88E+04 | 2.03E+05 | 6.30E+05 | 4.59E+05 | 4.38E+04 |
|  | (1.29E+04) | (4.52E+04) | (1.05E+05) | (1.84E+07) | (1.34E+04) | (1.13E+05) | (5.22E+05) | (2.48E+05) | (6.63E+04) |

TABLE 9-continued

Total Flux in Tissue (photons/sec/cm$^2$/radian): presented as AVE/(STD)

| Capsid | Brain | Lung | Heart | Liver | Spleen | Kidney | Gast.* | Quad. ** | Front Limb |
|---|---|---|---|---|---|---|---|---|---|
| AAVBfm25 | 2.84E+04 | 2.15E+05 | 1.65E+05 | 4.72E+07 | 4.37E+04 | 2.46E+05 | 1.29E+07 | 1.77E+05 | 2.63E+04 |
| | (1.71E+04) | (1.60E+05) | (1.14E+05) | (3.31E+07) | (2.95E+04) | (1.99E+05) | (2.52E+07) | (8.78E+04) | (4.27E+04) |
| AAVBfm34 | 4.08E+04 | 1.29E+05 | 1.12E+06 | 4.58E+07 | 5.93E+04 | 2.90E+05 | 4.86E+06 | 4.56E+06 | 5.36E+04 |
| | (3.95E+03) | (5.91E+04) | (8.04E+05) | (1.40E+07) | (2.20E+04) | (1.26E+05) | (4.35E+06) | (3.15E+06) | (2.67E+04) |
| AAVBce18 | 5.22E+04 | 2.10E+05 | 1.85E+05 | 1.03E+08 | 8.57E+04 | 2.65E+05 | 1.19E+05 | 1.72E+05 | 2.61E+03 |
| | (5.51E+04) | (1.89E+05) | (1.23E+05) | (1.30E+08) | (8.51E+04) | (3.36E+05) | (7.19E+04) | (1.30E+05) | (1.64E+03) |
| AAVBrh28 | 7.72E+04 | 2.62E+05 | 1.21E+06 | 7.27E+07 | 6.86E+04 | 3.76E+05 | 1.93E+06 | 2.29E+06 | 8.59E+04 |
| | (3.27E+04) | (8.93E+04) | (4.38E+05) | (2.83E+07) | (3.00E+04) | (1.31E+05) | (7.29E+05) | (1.09E+06) | (4.89E+04) |
| AAVBce20 | 4.35E+04 | 2.18E+05 | 6.48E+05 | 4.48E+07 | 5.82E+05 | 4.85E+05 | 3.59E+07 | 2.77E+06 | 1.92E+05 |
| | (1.80E+04) | (8.33E+04) | (2.59E+05) | (1.14E+07) | (2.58E+04) | (1.74E+05) | (7.32E+07) | (1.06E+05) | (6.47E+04) |

*Gast. = Gastrocnemius
** Quad. = Quadriceps

TABLE 10

| | Diaphragm | Quadriceps | Gast. | Heart | Liver |
|---|---|---|---|---|---|
| AAV5 | 0% | 5% | 2% | NA | 8% |
| AAV8 | 15% | 2% | 22% | NA | 18% |
| AAVanc110_9VR | 49% | 29% | 48% | 18% | 0.6% |
| Bba41 | 70% | 24% | 34% | 32% | 0.2% |

SEQUENCE LISTING (160 sequences)

SEQ ID NO: 1 - protein, 736 aa, Adeno-Associated Virus
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLWELQSTTSGGTLNQGNSATNFAKLTKTNFSGYRKNWLPGPMMKQQRFSKTASQNYKIPQGRNNSLLHYETRTTLDGRWSNFAPGTAMATAANDATDFSQAQLIFAGPNITGNTTTDANNLMFTSEDELRATNPRDTDLFGHLATNQQNATTVPTVDDVDGVGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 2 - protein, 713 aa, Adeno-Associated Virus
MSFFDWLGKQYAQGAAEFWDLKSGPPAPKKARKDGSAGFNFPGHKYLGPGNSLDRGDPVDADDAAAQKHDQSYQEQLEAGDNPYLKYNHADREFQEALKDDTSFEGNLARGLFEAKKLVAEPLGLVEPELAPPSGRKRPVQSSQESGYSSSQDKRPNLDVDEEDREFAAAAAETETGSAPPTGNLGPGTMAGGGSAPIDDGSYGADGVGNASGDWHCDSTWLDNCVITRTTRTWNLPTYNNHIYKRLNGTTSGDQSYFGFSTPWGYFDFNRFHCHFSPRDWQRLINNNWGLRPKSLRFKIFNIQVKEVTTQDSTKIISNNLTSTVQVFADTEYQLPYVIGSAHEGCLPPFPADVFMLPQYGYCTRQDGNSNNPTPRSAFYCLEYFPSKMLRTGNSFEFTYNFEKVPFHSMWAHNQSLDRLMNPLIDQYLYYLDVTSSTGFTYQKGVHTNLPEQERNWLPGPGIRNQAWFNSATGNNPLTGTWQYSNKYVLENRASKIAPGPAMGIESTKFDGNGIIFSKEYITNVNTANPNQVNITRETEINSTNPLAGGSLGAHANNSQNTTTAPTLDHTNVMGVFPGSVWQDRDIYLQGQIWAKIPHTDGHFHPSPLMGGFGLKNPPPQILIKNTPVPADPPTEFNANKISSFITQYSTGQVTVEMEWELQKETSKRWNPEIQYSDDSSSTSGSILHFAPDDVGNYKEFRSIGTRYLTRPL

SEQ ID NO: 3 - protein, 735 aa, Adeno-Associated Virus [sequence omitted]

SEQ ID NO: 4 - protein, 734 aa, Adeno-Associated Virus
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 5 - protein, 724 aa, Adeno-Associated Virus
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 6 - protein, 736 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 7 - protein, 736 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 8 - protein, 737 aa, Adeno-Associated Virus
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSNPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFEKQTGVDFAVDSQGVYSEPRPIGTRYLTRNL

SEQ ID NO: 9 - protein, 738 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 10 - protein, 736 aa, Adeno-Associated Virus
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 11 - protein, 736 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 12 - protein, 738 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 13 - protein, 736 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGSNTMAAGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKKLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTSGTAGNRTLQFSQAGPSSMANQAKNWLPGPCYRQQRVSKTTNQNNNSNFAWTGATKYHLNGRDSLVNPGPAMATHKDDEDKFFPMSGVLIFGKQGAGNSNVDLDNVMITNEEEIKTTNPVATEEYGTVATNLQSANTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 14 - protein, 736 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGSNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTGTAGTQTLQFSQAGPSSMANQARNWVPGPCYRQQRVSTTTNQNNNSNFAWTGATKYHLNGRDSLMNPGVAMASHKDDEDRFFPSSGVLIFGKQGAGNDNVDYSQVMITNEEEIKTTNPVATEEYGAVATNNQSANTQAQTGLVHNQGVLPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRYLTRNL

SEQ ID NO: 15 - protein, 742 aa, Papio hamadryas
MAADGYLPDWLEDNLSEGIREWWALKPGAPQPKANQQHQDNARGLVLPGYKYLGPGNGLDKGEPVNEADAAALEHDKAYDQQLKSGDNPYLKYNHADAEFQQRLATDTSFGGNLGKAVFQAKKRILEPLGLVEEGVKTAPGKKRPLEKTPNRPTNPDSGKAPAKKKQKDGETADSARRTLDFEDSGAGDGPPEGSSSGEMSHDAEMRAAPGGNAVEAGQGADGVGNASGDWHCDSTWSEGRVTTTSTRTWVLPTYNNHLYLRIGTTANSNTYNGFSTPWGYFDFNRFHCHFSPRDWQRLINNNWGLRPKSMRVKIFNIQVKEVTTSNGETTVANNLTSTVQIFADSTYELPYVMDAGQEGSLPPFPNDVFMVPQYGYCGVVTGENQNQTDRNAFYCLEYFPSQMLRTGNNFEVSYQFEKVPFHSMYAHSQSLDRMMNPLLDQYLWHPQSTTTGNSLNQGTATTTYGKITTGDFAYYRKNWLPGACIKQQKFSKNASQNYKIPASGGDALLKYDTHTTSNGRWSNMAPGPPMATAGAGDSDFSNSQLIFAGPNQSGNTTTSSNNLLFTSEEEIATTNPRDTDMFGQIADNNQNATTAPHIANLDAMGIVPGMVWQNRDIYYLGPIWAKVPHTDGHFHPSPLMGGFGLKHPPPQIFIKNTPVPANPNTTFSAARINSFLTQYSTGQVAVQIDWEIQKEHSKRWDPEVQFTSNYGTQNSMLWAPDNAGNYHEPRAIGSRFLTHHL

SEQ ID NO: 16 - protein, 739 aa, Papio hamadryas
MAADGYLPDWLEDNLSEGIREWWALKPGAPQPKANQQHQGNSRGLVLPGYKYLGLFNGLDKGEPVNEADAAALEHDKAYDKQLEQGDDPYLKYNHADAEFQERLQEDTSFGGNLGRAVFQAKKRILEPLGLVEEAAKTAPGKKRPLEKTPNQPTDTQAAGQTPAKKRPQGEQSGDSARRQLDFGPQPAAPIGQPPAAPPPVGSNTMASGGGGPMADDNQGADGVGNASGNWHCDSTWLGDRVITTSTRTWVLPTYNNHIYKQISSESGATNDNHYFGYSTPWGYFDFNRFHCHFSPRDWQRLINNNWGFRPKRLNFKIFNVQVKEVTQIEGGSTIANNLTSTIQVFADSEYQLPYVLGSAHQGCLPPFPADVFMIPQYGYLTLNNGSQSVGRSSFYCLEYFPSQMLRTGNNFQFSYTFESVPFHSSYAHSQSLDRIMNPLVDQYLYYLARTQTGTGSTTSNTRQLQFYQAGPSNMADQSRNWLPGPMYRQQRVSKTLDQNSNTNFAWTAASKYNLNGRKSLANPGIAMATHKDDEERFFPQHGVLVFGQTNATNKTTLDNVLVTSEEEIKATNPVATEEYGTVSSNLQASNTNPTTETVNNQGILPGMVWQDRDVYLQGPIWAKIPHTDGHFHPSPLMGGFGLKHPPPQILIKNTPVPANPPETFTTSKFASYITQYSTGQVSVEIEWELQKENSKRWNPEIQYTSNYAKSNNVEFSVDAAGVYSEPRPIGTRYLTRNL

SEQ ID NO: 17 - protein, 739 aa, Papio hamadryas
VAADGYLPDWLEDNLSEGIREWWALKPGAPQPKANQQHQDNSRGLVLPGYKYLGPFNGLDKGEPVNEADAAALEHDKAYDKQLEQGDNPYLKYNHADAELQERLQEDTSFGGNLGRAVFQAKKRILEPLGLVEEAAKTAPGKKRPLEKTPNQPTDTQAAGQTPAKKRPQGEQSGDSARRQLDFDPQPAAPIGQPPAAPPPVGSNTMASGGGGPMADDNQGADGVGNASGNWHRDSTWLGDRVITTSTRTWVLPTYNNHIYKQISSESGATNDNHYFGYSTPWGYFDFNRFHCHFSPRDWQRLINNNWGFRPKRLNFKIFNIQVKEVTQIEGGSTIANNLTSTIQVFADSEYQLPYVLGSAHQGCLPPFPADVFMIPQYGYLTLNNGSQSVGRSSFYCLEYFPSQMLRTGNNFQFSYTFESVPFHSSYAHSQSLDRIMNPLVDQYLYYLARTQTGTGSTTSNTRQLQFYQAGPSNMADQSRNWLPGPMYRQQRVSKTLDQNSNTNFAWTAASKYNLNGRKSLANPGIAMATHKDDEERFFPQHGVLVFGQTNATNKTTLDNVLITSEEEIKATNPVATEEYGTVSSNLQASNTNPTTETVNSQGILPGMVWQDRDVYLQGPIWAKIPHTDGHFHPSPLMGGFGLKHPPPQILIKNTPVPANPPETFTTSKFASYITQYSTGQVSVEIEWELQKENGKRWNPEIQYTSNYAKSNNVEFSVDAAGVYSEPRPIGTRYLTRNL

SEQ ID NO: 18 - protein, 739 aa, Papio hamadryas
MAADGYLPDWLEDNLSEGIREWWALKPGAPQPKANQQHQDNSRGLVLPGYKYLGPFNGLDKGEPVNEADAAALEHDKAYDKQLEQGDNPYLKYNHADAEFQERLQEDTSFGGNLGRAVFQAKKRILEPLGLVEEAAKTAPGKRRPLEKTPNQPTDTQAAGQTPAKKRPQGEQSGDSARRQLDFDPQPAAPIGQPPAAPSPVGSNTMASGGGGPMADDNQGADGVGNASGNWHCDSTWLGDRVITTSTRTWVLPTYNNHIYKQISSESGATNDNHYFGYSTPWGYFDFNRFHCHFSPRDWQRLINNNWGFRPKRLNFKIFNIQVKEVTQIEGGSTIANNLTSTIQVFADSEYQLPYVLGSAHQGCLPPFPADVFMIPQYGYLTLNNGSQSVGRSSFYCLEYFPSQMLRTGNNFQFSYTFESVPFHSSYAHSQSLDRIMNPLVDQCLYYLARTQTGTGSTTSNTRQLQFYQAGPSNMADQSRNWLPGPMYRQQRVSKTLDQNSNTNFAWTAASKYNLNGRKSLANPGIAMATHKDDEERFFPQHGVLVFGQTNATNKTTLDNVLITSEEEIKATNPVATEEYGTVSSNLQASNTNPTTETVNNQGILPGMVWQDRDVYLQGPIWAKIPHTDGHFHPSPLMGGFGLKHPPPQILIKNTPVPANPPETFTTSKFASYITQYSTGQVSVEIEWELQKEDSKRWNPEIQYTSNYAKSNNVEFSVDAAGVYSEPRPIGTRYLTRNL

SEQ ID NO: 19 - protein, 739 aa, Papio hamadryas
MAADGYLPDWLEDNLSEGIREWWALKPGAPQPKANQQHQDNSRGLVLPGYKYLGPFNGLDKGEPVNEADAAALEHDKAYDKQLEQGDNPYLKYNHADAEFQERLQEDTSFGGNLGRAVFQAKKRILEPLGLVEEAAKTAPGKKRPLEKTPNQPTDTQAAGQTPAKKRPQGGQSGDSARRQLDFDPQPAAPIGQPPAAPSPVGSNTMASGGGGPMADDNQGADGVGNASGNWHCDSTWLGDRVITTSTRTWVLPTYNNHIYKQISSESGATNDNHYFGYSTPWGYFDFNRFHCHFSPRDWQRLINNNWGFRPKRLNFKIFNIQVKEVTQIEGGSTIANNLTSTIQVFADSEYLLPYVLGSAHQGCLPPFPADVFMIPQYGYLTLNNGSQSVGRSSFYCLEYFPSQMLRTGNNFQFSYTFESVPFHSSYAHSQSLDRIMNPLVDQYLYYLARTQTGTGSTTSNTRQLQFYQAGPSNMADQSRNWLPGPMYRQQRVSKTLDQNSNTNFAWTAASKYNLNGRKSLANPGIAMATHKDDEERFFPQHGVLVFGQTNATNKTTLDNVLITSEEEIKATNPVATEEYGTVSSNLQASNTNPTTETVNNQGILPGMVWQDRDVYLQGPIWAKIPHTDGHFHPSPLMGGFGLKHPPPQILIKNTPVPANPPETFTTSKFASYITQYSTGQVSVEIEWELQKEDSKRWNPEIQYTSNYAKSNNVEFSVDAAGVYSEPRPIGTRYLTRNL

SEQ ID NO: 20 - protein, 742 aa, Papio hamadryas
MAADGYLPDWLEDNLSEGIREWWALKPGAPQPKANQQHQDNARGLVLPGYKYLGPGNGLDKGEPVNEADAAALEHDKAYDQQLKSGDNPYLKYNHADAEFQQRLATDTSFGGNLGKAVFQAKKRILEPLGLVEEGVKTAPGKKHPLEKTPNRPTNPDSGKAPAKKKQKDGETADSARRTLDFEDSGAGDGPPEGSSSGEMSHDAEMRAAPGGNAVEAGQGADGVGNASGDWHCGSTWSEGRVTTTSTRTWVLPTYNNHLYLRIGTTANSNTYNGFSTPWGYFDFNRFHCHFSPRDWQRLINNNWGLRPKSMRVKIFNIQVKEVTTSNGETTVANNLTSTVQIFADSTYELPYVMDAGQEGSLPPFPNDVFMVPQYGYCGVVTGENQNQTDRNAFYCLECFPSQMLRTGNNFEISYQFEKVPFHSMYAHSQSLDRMMNPLLDQYLWHLQSTTTGNSLNQGTATTTYGKITTGDFAYYRKNWLPGACIKQQKFSKNASQNYKIPASGGDALLKYDTHTTLNGRWSNMAPGPPMATAGAGDSDFSNSQLIFAGPNQSGNTTTSSNNLLFTSEEEIAATNPRDTDMFGQIADNNQNATTAPHIANLDAMGIVPGMVWQNRDIYYQGPIWAKVPHTDGHFHPSPLMGGFGLKHPPPQIFIKNTPVPANPNTTFSAARINSFLTQYSTGQVAVQIDWEIQKEHSKRWNPEVQFTSNYGTQNSMLWAPDNAGNYHEPRAIGSRFLTHHL

SEQ ID NO: 21 - protein, 742 aa, Papio hamadryas
MAADGYLPDWLEDNLSEGIREWWALKPGAPQPKANQQHQDNARGLVLPGYKYLGPGNGLDKGEPVNEADAAALEHDKAYDQQLKSGDNPYLKYNHADAEFQQRLATDTSFGGNLGKAVFQAKKRILEPLGLVEEGVKTAPGKKRPLEKTPNRPTNPDSGKAPAKKKQKDGETADSARRTLDFEDSGAGDGPPEGSSSGEMSHDAEMRAAPGGNAVEAGQGADGVGNASGGWHCDSTWSEGRVTTTSTRTWVLPTYNNHLYLRIGTTANSNTYNGFSTPWGYFDFNRFHCHFSPRDWQRLINNNWGLRPKSMRVKIFNIQVKEVTTSNGETTVANNLTSTVQIFADSTYELPYVMDAGQEGSLPPFPNDVFMVPQYGYCGVVTGENQNQTDRNAFYCLEYFPSQMLRTGNNFEISYQFEKVPFHSMYAHSQSLDRMMNPLLDQYLWHLQSTTTGNSLNQGTATTTYGKITTGDFAYYRKNWLPGACIKQQKFSKNASQNYKIPASGGDALLKYDTHTTLNGRWSSMAPGPPMATAGAGDSDFSNSQLIFAGPNQSGNTTTSSNNLLFTSEEEIATTNPRDTDMFGQIADNNQNATTAPHIANLDAMGIVPGMVWQNRDIYYQGPIWAKVPHTDGHFHPSPLMGGFGLKHPPPQIFIKNTPVPANPNTTFSAARINSFLTQYSTGQVAVQIDWEIQKEHSKRWNPEVQFTSNYGTQNSMLWAPGNAGNHHEPRAIGSRFLTHHL

SEQ ID NO: 22 - protein, 742 aa, Papio hamadryas
MAADGYLPDWLEDNLSEGIREWWALKPGAPQPKANQQHQDNARGLVLPGYKYLGPGNGLDKGEPVNEADAAALEHDKAYDQQLKSGDNPYLKYNHADAEFQQRLATDTSFGGNLGKAVFQAKKRILEPLGLVEEGVKTAPGKKRPLEKTPNRPTNPDSGRAPAKKKQKDGETADSARRTLDFEDSGAGDGPPEGSSSGEMSHDAEMRAAPGGNAVEAGQGADGVGNASGDWHCDSTWSEGRVTTTSTRTWVLPTYNNHLYLRIGTTANSNTYNGFSTPWGYFDFNRFHCHFSPRDWQRLINNNWGLRPKSMRVKIFNIQVKEVTTSNGETTVANNLTSTVQIFADSTYELPYVMDAGQEGSLPPFPNDVFMVPQYGYCGVVTGENQNQTDRNAFYCLEYFPSQMLRTGNNFEISYQFEKVPFHSMYAHSQSLDRMMNPLLDQYLWHLQSTTTGNSLNQGTATTTYGKITTGDFAYYRKNWLPGACIKQQKFSKNASQNYKIPASGGDALLKYDTHTTLNGRWSNMAPGPPMATAGAGDSDFSNSQLIFAGPNQSGNTTTSSNNLLLTSEEEIATTNPRDTDMFGQIADNNQNATTAPHIANLDAMGIVPGMVWQNRDIYYQGPIWAKVPHTDGHFHPSPLMGGFGLKHPPPQIFIKNTPVPANPNTTFSAARINSFLTQYSTGQVAVQIDWEIQKEHSKRWNPEVQFTSNYGTQNSMLWAPGNAGNYHEPRAIGSRFLTHHL

SEQ ID NO: 23 - protein, 739 aa, Papio hamadryas
MAADGYLPDWLEDNLSEGIREWWALKPGAPQPKANQQHQDNSRGLVLPGYKYLGPFNGLDKGEPVNEADAAALEHDKAYDKQLEQGDNPYLKYNHADAEFQERLQEDTSFGGILGRAVFQAKKRILEPLGLVEEAAKTAPGKKRPLEKTPNQPTDTQAAGQTPAKKRPQGEQSGDSARRQLDFDPQPAAPIGQPPAAPSPVGSNTMASGGGGPMADDNQGADGVGNASGNWHCDSTWLGDRVITTSTRTWVLPTYNNHIYKQISSESGATNDNHYFGYSTPWGYFDFNRFHCHFSPRDWQRLINNNWGFRPKRLNFKIFNIQVKEVTQIEGGSTIANNLTSTIQVFADSEYQLPYVLGSAHQGCLPPFPADVFMIPQYGYLTLNNGSQSVGRSSFYCLEYFPSQMLRTGNNFQFSYTFESVPFHSSYAHSQSLDRIMNPLVDQYLYYLARTQTGTGSTTSNTRQLQFYQAGPSNMADQSRNWLPGPMYRQQRVSKTLDQNSNTNFAWTAASKYNLNGRKSLVNPGIAMATHKDDEERFFPQHGVLVFGKTNATNKTTLENVLVTDEEEVKATNPVATEEYGTVSSNLQSNTTNPTTETVNNQGILPGMVWQDRDVYLQGPIWAKIPHTDGHFHPSPLMGGFGLKHPPPQILIKNTPVPANPPETFTTSKFASYITQYSTGQVSVEIEWELQKENSKRWNPEIQYTSNYAKSNNVEFSADAAGVYSEPRPIGTRYLTRNL

SEQ ID NO: 24 - protein, 739 aa, Papio hamadryas
MAADGYLPDWLEDNLSEGIREWWALKPGAPQPKANQQHQDNSRGLVLPGYKYLGPFNGLDKGEPVNEADAAALEHDKAYDKQLEQGDNPYLKYNHADAEFQERLQEDTSFGGNLGRAVFQAKKRILEPLGLVEEVAKTAPGKKRPLEKTPNQPTDTQAAGQTPAKKRPQGEQSGDSARRQLDFDPQPAAPIGQPPAAPSPVGSNTMASGGGGPMADDNQGADGVGNASGNWHCDSTWLGDRVITTSTRTWVLPTYNNHIYKQISSESGATNDNHYFGYSTPWGYFDFNRFHCHFSPRDWQRLINNNWGFRPKRLNFKIFNIQVKEVTQIEGGSTIANNLTSTIQVFADSEYQLPYVLGSAHQGCLPPFPADVFMIPQYGYLTLNNGSQSVGRSSFYCLEYFPSQMLRTGNNFQFSYTFESVPFHSSYAHSQSLDRIMNPLVDQYLYYLARTQTGTGSTTSNTRQLQFYQAGPSNMADQSRNWLPGPMYRQQRVSKTLDQNSNTNFAWTAASKYNLNGRKSLANPGIAMATHKDDEERFFPQHRVLVFGQTNATNKTTLDNVLITSEEEIKATNPVATEEYGTVSSNLQASNTDPTTETVNNQGILPGMVWQDRDVYLQGPIWVKIPHTDGHFHPSPLMGGFGLKHPPPQILIKNTPVPANPPETFTTSKFASYTTQYSTGQVSVEIEWGLQKENSKRWNPEIQYTSNYAKSNNVEFSVDAAGVYSEPRPIGTRYLTRNL

SEQ ID NO: 25 - protein, 739 aa, Papio hamadryas
MAADGYLPDWLEDNLSEGIREWWALKPGAPQPKANQQHQDNSRGLVLPGYKYLGPFNGLDKGEPVNEAYAAALEHDKAYDKQLEQGDNPYLKYNHADAEFQERLQEDTSFGGNLGRAVFQAKKRIPEPLGLVEEAAKTAPGKKRPLEKTPNQPTDTQAAGQTPAKKRPQGEQSGDSARRQLDFDPQPAAPIGQPPAAPSPVGSNTMASGGGGPMADDNQGADGVGNASGNWHCDSTWLGDRVITTSTRTWVLPTYNNHIYKQISSESGATNDNHYFGYSTPWGYFDFNRFHCHFSPRDWQRLINNNWGFRPKRLNFKIFNIQVKEVTQIEGGSTIANNLTSTIQVFADSEYQLPYVLGSAHQGCLPPFPADVFMIPQYGYLTLNNGSQSVGRPSFYCLEYFPSQMLRTGNNFQFSYTFESVPFHSSYAHSQSLDRIMNPLVDQYLYYLARTQTGTGSTTSNTRQLQFYQAGPSNMADQSRNWLPGPMYRQQRVSKTLDQNSNTNFAWTAASKYNLNGRKSLANPGIAMATHKDDEERFFPQHGVLVFGQTNATNKTTLDNVLITSEEEIKATNPVATEEYGTVSSNLQASNTNPTTETVNNQGILPGMVWQDRDVYLQGPIWAKIPHTDGHFHPSPLMGGFGLKHPPPQILIKNTPVPANPPETFTTSKFASYITQYSTGQVSVEIEWELQKENSKRWNPEIQYTSNYAKSNNVEFSVDAAGVYSEPRPIGTRYLTRNL

SEQ ID NO: 26 - protein, 739 aa, Papio hamadryas
MAADGYLPDWLEDNLSEGIREWWALKPGAPQPKANQQHQDNSRGLVLPGYKYLGPFNGLDKGEPVNEADAAALEHDKAYDKQLEQGDNPYLKYNHADAEFQERLQEDTSFGGNLGRAVFQAKKRILEPLGLVEEAAETAPGKKRPLEKTPNQPTDTQAAGQTPAKKRPQGEQSGDSARRQLDFDPQPAAPIGQPPAAPSPVGSNTMASGGGGPMADDNQGADGVGNASGNWHCDSTWLGDRVITTSTRTWVLPTYNNHIYKQISSESGATNDNHYFGYSTPWGYFDFNRFHCHFSPRDWQRLINNNWGFRPKRLNFKIFNIQVKEVTQTEGGSTIANNLTSTIQVFADSEYQLPYVLGSAHQGCLPPFPADVFMIPQYGYLTLNNGSQSVGRSSFYCLEYFPSQMLRTGNNFQFSYTFESVPFHSSYAHSQSLDRIINPLVDQYLYYLARTQTGTGSTTSNTRQLQFYQAGPSNMADQSRNWLPGPMYRQQRVSKTLDQNSNTNFAWTAASKYNLNGRKSLANPGIAMATHKDDEERFFPQHGVLVFGQTNATNKTTLDNVLITSEEEIKATNPVATEEYGTVSSNLQASNTNPTTETVNNQGILPGMVWQDRDVYLQGPIWAKIPHTDGHFHPSPLMGGFGLKHPPPQILIKNTPVPANPPETFTTSKFASYITQYSTGQVSVEIEWELQKENSKRWNPEIQYTSNYAKSNNVEFSVDAAGVYSEPRPIGTRYLTRNL

SEQ ID NO: 27 - protein, 739 aa, Papio hamadryas
MAADGYLPDWLEDNLSEGIRGWWALKPGAPQPKANQQHQDNSRGLVLPGYKYLGPFNGLDKGEPVNEADAAALEHDKAYDKQLEQGDNPCLKYNHADAEFQERLQEDTSFGGNLGRAVFQAKKRILEPLGLVEEAAKTAPGKKRPLEKTPNQPTDTQAAGQTPAKKRPQGEQSGDSARRQLDFDPQPAAPIGQPPAAPSPVGSNTMASGGGGPMADDNQGADGVGNASGNWHCDSTWLGDRVITTSTRTWVLPTYNNHIYKQISSESGATNDNHYFGYSTPWGYFDFNRFHCHFSPRDWQRLINNNWGFRPKRLNFKIFNIQVKEVTQIEGGSTIANNLTSTIQVFADSEYQLPYVLGSAHQGCLPPFPADVFMIPQYGYLTLNNGSQSVGRSSFYCLEYFPSQMLRTGNNFQFSYTFESVPFHSSYAHSQSLDRIMNPLVDQYLYYLARTQTGTGSTTSNTRQLQFYQAGPSNMADQSRNWLPGPMYRQQRVSKTLDQNSNTNFAWTAASKYNLNGRKSLANPGIAMATHKDDEERFFPQHGVLVFGQTNATNKTTLDNVLITSEEEIKATNPVATEEYGTVSSNLQASNTNPTTETVNNQGILPGMVWQDRDVYLQGPTWAKIPHTDGHFHPSPLMGGFGLKHPPPQILIKNTPVPANPPETFTTSKFASYITQYSTGQVSVEIEWELQKENSKRWNPEIQYTSNYAKSNNVEFSVDAAGVYSEPRPIGTRYLTRNL

SEQ ID NO: 28 - protein, 739 aa, Papio hamadryas
MAADGYLPDWLEDNLSEGIREWWALKPGAPQPKANQQHQDNSRGLVLPGYKYLGPFNGLDKGEPVNEADAAALEHDKAYDKQLEQGDNPYLKYNHADAEFQERLQEDTSFGGNLGRAVFQAKKRILEPLGLVEEAAKTAPGKKRPLEKTPNQPTDTQAAGQTPAKKRPQGEQSGDSARRQLDFDPQPAAPIGQPPAAPSPVGSNTMASGGGGPMADDNQGADGVGNASGNWHCDSTWLGDRVITTSTRTWVLPTYNNHIYKQISSESGATNDNHYFGYSTPWGYFDFNRFHCHFSPRDWQRLINNNWGFRPKRLNFKIFNIQVKEVTQIEGGSTIANNLTSTIQVFADSEYQLPYVLGSAHQGCLPPFPADVFMIPQYGYLTLNNGSQSVGRSSFYCLEYFPSQMLRTGNSFQFSYTFESVPFHSSYAHSQSLDRIMNPLVDQYLYYLARTQTGTGSTTSNTRQLQFYQAGPSNMADQSRNWLPGPMYRQQRVSKTLDQNSNTNFAWTAASKYNLNGRKSLANPGIAMATHKDDEERFFPQHGVLVFGQTNATNKTTLDNVLITSEEEIKATNPVATEEYGTVSSNLQASNTNPTTETVNNQGILPGMVWQDRDVYLQGPIWAKIPHTDGHFHPSPLMGGFGLKHPPPQILIKNTPVPANPPETFTTSKFASYITQYSTGQVSVEIEWELQKENSKRWNPEIQYTSNYAKSNNVEFSVDAAGVYSEPRPIGTRYLTRNL

SEQ ID NO: 29 - protein, 739 aa, Papio hamadryas
MAADGYLPDWLEDNLSEGIREWWALKPGAPQPKANQQHQDNSRGLVLPGYKYLGPFNGLDKGEPVNGADAAALEHDKAYDKQLEQGDNPYLKYNHADAEFQERLQEDTSFGGNLGRAVFQAKKRILEPLGLVEEAAKTAPGKKRPLEKTPNQPTDTQAAGQTPAKKRPQGEQSGDSARRQLDFDPQPAAPIGQPPAAPSPVGSNTMASGGGGPMADDNQGADGVGNASGNWHCDSTWLGDRVITTSTRTWVLPTYNNHIYKQISSESGATNDNHYFGYSTPWGYFDFNRFHCHFSPRDWQRLINNNWGFRPKRLNFKIFNIQVKEVTQIEGGSTIANNLTSTIQVFADSEYQLPYVLGSAHQGCLPPFPADVFMIPQYGYLTLNNGSQSVGRSSFYCLEYFPSQMLRTGNNFQFSYTFESVPFHSSYAHSQSLDRIMNPLVDQYLYYLARTQTGTGSTTSNTRQLQFYQAGPSNMADQSRNWLPGPMYRQQRVSKTLDQNSNTNFAWTAASKYNLNGRKSLVNPGIAMATHKDDEERFFPQHGVLVFGKTNATNKTTLENVLVTDEEEVKATNPVATEEYGTVSSNLQSNTTNPTTETVNNQGILPGMVWQDRDVYLQGPIWAKIPHTDGHFHPSPLMGGFGLKHPPPQILIKNTPVPANPPETFTTSKFASYITQYSTGQVSVEIEWELQKENSKRWNPEIQYTSNYAKSNNVEFSVDAAGVYSEPRLIGTRYLTRNL

SEQ ID NO: 30 - protein, 739 aa, Papio hamadryas
MAADGYLPDWLEDNLSEGIREWWALKPGAPQPKANQQHQDNSRGLVLPGYKYLGPFNGLDKGEPVNEADAAALEHDKAYDKQLEQGDNPYLKYNHADAEFQERLQEDTSFGGNLGRAVFQAKKRILEPLGLVEEAAKTAPGKKRPLEKTPNQPTDTQAAGQTPAKKRPQGEQSGDSARRQLDFDPQPAAPIGQPPAAPSPVGSNTMASGGGGPMADDNQGADGVGNASGNWHCDSTWLGDRVITTSTRTWVLPTYNNHIYKQISSESGATNDNHYFGYSTPWGYFDFNRFHCHFSPRDWQRLINNNWGFRPKRLNFKIFNIQVKEVTQIEGGSTIANNLTSTIQVFADSEYQLPYVLGSAHQGCLPPFPADVFMIPQYGYLTLNNGSQSVGRSSFYCLEYFPSQMLRTGNNFQFSYTFESVPFHSSYAHSQSLDRIMNPLVDQYLYYLARTQTGTGSTTSNTRQLQFYQAGPSNMADQSRNWLPGPMYRQQRVSKTLDQNSNTNFAWTAASKYNLNGRKSLVNPGIAMATHKDDEERFFPQHGVLVFGKTNATNKTTLENVLVTDEEEVKATNPVATEEYGTVSSNLQSNTTNPTTETVNNQGILPGMVWQDRDVYLQGPIWAKIPHTDGHFHPSPLMGGFGLKHPPPQILIKNTPVPANPPETFTTSKFASYITQYSTGQVSVEIEWELQKENSKRWNPEIQYTSNYAKSNNVEFSVDAAGVYSEPRPIGTRYLTRNL

SEQ ID NO: 31 - protein, 739 aa, Papio hamadryas
MAADGYLPDWLEDNLSEGIREWWALKPGAPQPKANQQHQDNSRGLVLPGYKYLGPFNGLDKGEPVNEADAAALEHDKAYDKQLEQGDNPYLKYNHADAEFQERLQEDTSFGGNLGRAVFQAKKRILEPLGLVEEAAKTAPGKKRPLEKTPNQPTDTQAAGQTPAKKRPQGEQSGDSARRQLDFDPQPAAPIGQPPAAPSPVGSNTMASGGGGPMADDNQGADGVGNASGNWHCDSTWLGDRVITTSTRTWVLPTYNNHIYKQISSESGATNDNHYFGYSTPWGYFDFNRFHCHFSPRDWQRLINNNWGFRPKRLNFKIFNIQVKEVTQIEGGSTIANNLTSTIQVFADSEYQLPYVLGSAHQGCLPPFPADVFMIPQYGYLTLNNGSQSVGRSSFYCLEYFPSQMLRTGNNFQFSYTFESVPFHSSYAHSQSLDRIMNPLVDQYLYYLARTQTGTGSTTSNTRQLQFYQAGPSNMADQSRNWLPGPMYRQQRVSKTLDQDSNTNFAWTAASKYNLNGRKSLVNPGIAMATHKDDEERFFPQHGVLVFGKTNATNKTTLENVLVTDEEEVKATNPVATEEYGTVSSNLQSNTTNPTTETVNNQGILPGMAWQDRDVYLQGPIWAKIPHTDGHFHPSPLMGGFGLKHPPPQILIKNTPVPANPPETFTTSKFASYITQYSTGQVSVEIEWELQKENSKRWNPEIQYTSNYAKSNNVEFSVDAAGVYSEPRPIGTRYLTRNL

SEQ ID NO: 32 - protein, 736 aa, Macaca fascicularis
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFTFSYEFENVPFHSSYAHSQSLDRLMNPLIDQYLYYLSKTINGSGQNQQALKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLVGGFGMKHPPPQILIKNTPVPADPPTAFNKDKLNSFITQYSTGQVRVEIEWELQKENSKRWNPEIQYTSNYYKSNNVEFAVNTEGVYSEPRPIGTRYLTRNL

SEQ ID NO: 33 - protein, 736 aa, Macaca fascicularis
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMPRTGNNFTFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVAIEWELQKENSKRWNPEIQYTSNYYKSNNVEFAVNTEGVYSEPRPIGTRYLTRNL

SEQ ID NO: 34 - protein, 736 aa, Macaca fascicularis
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFTFSYEFENVPFHSSYAHSQSLDRPMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 35 - protein, 736 aa, Macaca fascicularis
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEAAKTAPGKKRPVEQSPQEPDSSAGIGKSGAQPAIKRLNFGQTGDTESVPDPQPIGEPPAAPSGVGSLTMASGGGAPVADNNEGADGVGSSSGNWHCDSQWLGDRVITTSIRTWALPTYNNHLYKQISNSTSGGSSNDNAYFGYSTPWGYFDFSRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFTFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 36 - protein, 736 aa, Macaca fascicularis
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFTFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 37 - protein, 733 aa, Macaca fascicularis
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSRWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGAKTIANNLTSTVQVFTDSDYQLPYVLGSAHEGCLPPFPADVFMIPQYGYLTLNDGSQAVGRSSFYCLEYFPSQMLRTGNNFTFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLT

SEQ ID NO: 38 - protein, 730 aa, Macaca fascicularis
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVLQAKKRVLEPLGLVEEAAKTAPGKKRPVDSPDSTSGIGKKGQQPARKRLNFGQTGDAESVPDPQPIGEPPAAPSGLGSGTMAAGGGAPMADNNEGADGVGNASGNWHCDSTWLGNRVITTSTRTWALPTYNNHLYKQISSSSSGATNDNHYFGYSTPWGYFDFNRFHCHFSPRDWQRLINNNWGFRPKRLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYEFEDVPFHSSYAHSQSLDRLMNPLIDQYLYYLARTQSSTGTSTRELQFHQAGPATMAEQSKNWLPGPCFRQQRISKTTDNNNNSNFAWTGATKYHLNGRSSLTNPGVPMATHKDDESVFFPINGVLVFGKTGASNKTTLENVLMTDEEEIKATNPVATEEYGVVSSNIQSQNSNPTTQTVNNQGALPGMVWQNRDVYLQGPIWAKIPHTDGNFHPSPLMGGFGLKHPPPQILIKNTPVPANPPETFTPAKFASFITQYSTGQVSVEIEWELQKENSKRWNPEIQYTSNYDKQTGVGFAVDTQGVYSEPRPIGTRYLTRNL

SEQ ID NO: 39 - protein, 730 aa, Macaca fascicularis
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEAAKTAPGKKRPVDSPDSTSGIGKKGQQPARKRLNFGQTGDAESVPDPQPIGEPPAAPSGLGSGTMAAGGGAPMADNNEGADGVGNASGNWHCDSTWLGNRVITTSTRTWALPTYNNHLYKQISSSSSGATNDNHYFGYSTPWGYFDFNRFHCHFSPRDWQRLINNNWGFRPKRLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYEFEDVPFHSSYAHSQSLDRLMNPLIDQYLYYLARTQSSTGTSTRELQFHQAGPATMAEQSKNWLPGPCFRQQRISKTTDNNNNSNFAWTGATKYHLNGRNSLTNPGVPMATHKDDESVFFPINGVLVFGKTGASNKTTLENVLMTDEEEIKATNPVATEEYGVVSSNIQSQNSNPTTQTVNNQGALPGMVWQNRDVYLQGPIWAKIPHTDGNFHPSPLMGGFGLKHPPPQILIKNTPVPANPPETFTPAKFASFITQYSTGQVSVEIEWELQKENSKRWNPEIQYTSNYDKQTGVDFAVDTQGVYSEPRPIGTRYLTRNL

SEQ ID NO: 40 - protein, 736 aa, Macaca fascicularis
MAADGYLPDWLEDNLSEGIREWWDLKPGAPKPKANQQKQDDGRGLVLPGYKYPGPFNGLDKGEPVNAADAAALEHDKAYDQQLKAGDNPYLRYNHADAEFQERLQEDTSFGGNLGRAVFQAKKRVFEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNSTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPSYRQQRVSTTKNQNNNSNFAWTGAAKFKLNGRNSLMNPGVAMASHKDDEDRFFPSSGVLIFGKQGAGNDGVDYSQVLITDEEEIKATNPVATEEYGEVAINDQAANTQAQTGLVHNQGVIPGMVWQNRDVYLQGPIWAKIPHTDGNFHPSPLMGGFGLMHPPPQILIKNTPVPADPPLTFNQAKLNSFITQYSTGQVSVEIEWELQKENSKRWNPEIQYTSNYYKSTNVDFAVNSDGVYSEPRPIGTRYLTRNL

SEQ ID NO: 41 - protein, 736 aa, Macaca fascicularis
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQGRLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNSTSGGSTNDNTYFGYSTPWGYFDFNRFHCHFSPRDWQRLINNNWGFRPKRPNFKLFNIQVKEVTTNEGTKTIANNLTSTVQAFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPSYRQQRVSTTKNQNNNSNFAWTGAAKFKLNGRNSLMNPGVAMASHKDDEDRFSPSSGVLIFGKQGAGNDGVDYSQVLITDEEEIKATNPVATEEYGEVAINDQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNSDGVYSEPRPIGTRYLTRNL

SEQ ID NO: 42 - protein, 736 aa, Macaca fascicularis
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQGRLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNSTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQILAFSQAGPSSMANQARNWVPGPSYRQQRVSTTKNQNNNSNFAWTGAAKFKLNGRNSLMNPGVAMASHKDDEDRFFPSSGVLIFGKQGAGNDGMDYSQVLITDEEEIKATNPVATEEYGEVAINDQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNSDGVYSEPRPIGTRYLTRNL

SEQ ID NO: 43 - protein, 736 aa, Macaca fascicularis
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNSTSGGGTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGHLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPSYRQQRVSTTKDQNNNSNFAWTGAAKFKLNGRNSLMNPGVAMASHKDDEDRFFPSSGVLIFGKQGAGNDGVDYSQVLITDEEEIKATNPVATEEYGEVAVNDQAANTQAQTGLVHNQGVIPGMVWQNRDVYLQGPIWAKIPHTDGNFHPSPLMGGFGLKHPPPQILIKNTPVPADPPLTLNQAKLNSFITQYSTGQVSVEIEWELQKENSKRWNPEIQYTSNYYKSTNVDFAVNSDGVYSEPRPIGTRYLTRNL

SEQ ID NO: 44 - protein, 730 aa, Macaca fascicularis
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEAAKTAPGKKRPVDSPDSTSGIGKKGQQPARKRLNFGQTGDAESVPDPQPIGEPPAAPSGLGSGTMAAGGGAPMADNNEGADGVGNAPGNWHCDSTWLGNRVITTSTRTWALPTYNNHLYKQISSSSSGATNDNHYFGYSTPWGYFDFNRFHCHFSPRDWPRLINNNWGFRPKRLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYEFEDVPFHSSYAHSQSLDRLMNPLIDQYPYYLARTQSSTGTSTRELQFHQAGPATMAEQSKNWLPGPCFRQQRISKTTDNNNNSNFAWTGATKYHLNGRNSLTNPGVPMATHKDDESVFFPINGVLVFGKTGASNKTTLENVLMTDEEEIKATNPVATEEYGVVSSNIQSQNSNPATQTVNNQGALPGMVWQNRDVYLQGPIWAKIPHTDGNFHPSPLMGGFGLKHPPPQILIKNTPVPANPPETFTPAKFASFITQYSTGQVSVEIEWELQKENSKRWNPEIQYTSNYDKQTGVDFAVDTQGVYSEPRPIGTRYLTRNL

SEQ ID NO: 45 - protein, 730 aa, Macaca fascicularis
MAADGYLPDWLEDNLSEGIREWWALKPGAPQPKANQQKQDDGRGLMLPGYKYLGPFNGLDKGEPVNEADAAALEHDKAYDQQLKAGDNPYLRYNHADAEFQERLQEDTSFGGNLGRAVFQAKKRVLEPLGLVEEAAKTAPGKKRPVDSPDSTSGIGKKGQQPARKRLNFGQTGDAESVPDPQPIGEPPAAPSGLGSGTMAAGGGAPMADNNEGADGVGNASGSWHCDSTWLGNRVITTSTRTWALPTYNNHLYKQISSSSSGATNDNHYFGYSTPWGYFDFNRFHCHFSPRDWQRLINNNWGFRPKRLRFKLFNIQVKEVTTNDGVTTIANNLTSTVQVFSDSEYQLPYVLGSAHQGCLPPFPADVFMIPQYGYLTLNNGRQSVGRSSFYCLEYFPSQMLRTGNNFEFSYEFEDVPFHSSYAHSQSLDRLMNPLIDQYPYYLARTQSSTGTSTRELQFHQAGPATMAEQSKNWLPGPCFRQQRISKTTDNNNNSNFAWTGATKYHLNGRNSLTNPGVPMATHKDDESVFFPINGVLVFGKTGASNKTTLENVPMTDEEEIKATNPVATEEYGVVSSNIQSQNSNPTTQTVNNQGALPGMVWQNRDVYLQGPIWAKIPHTDGNFHPSPLMGGFGLKHPPPQILIKNTPVPANPPETFTPAKFASFITQYSTGQVSVEIEWELQKENNKRWNPEIQYTSNYDKQTGVDFAVDTQGVYSEPRPIGTRYLTRNL

SEQ ID NO: 46 - protein, 730 aa, Macaca fascicularis
MAADGYLPDWLEDNLSEGIREWWALKPGAPQPKANQQKQDDGRGLVLPGYKYLGPFSGLDKGEPVNEADAAALEHDKAYDQQLKAGDNPYLRYNHADAEFQERLQEDTSFGGNLGRAVFQAKKRVLEPLGLVEEAAKTAPGKKRPVDSPDSTSGIGKKGQQPARKRLNFGQTGDAESVPDPQPIGEPPAAPSGLGSGTMAAGGGAPMADNNEGADGVGNASGNWHCDSTWLGNRVITTSTRTWALPTYNDHLYKQISSSSSGATNDNHYFGYSTPWGYFDFNRFHCHFSPRDWQRLINNNWGFRPKRLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYEFEDVPFHSSYAHSQSLDRLMNPLIDQYLYYLARTQSSTGTSTRELQFHQAGPATMAEQSKNWLPGPCFRQQRISKTTDNNNNSNFAWTGATKYHLNGRNSLTNPGVPMATHKDDESVFFPINGVLVFGKTGASNKTTLENVLMTDEEEIKATNPVATEEYGVVSSNIQSQNSNPTTQTVNNQGALPGMVWRNRDVYLQGPIWAKIPHTDGNFHPSPLMGGFGLKHPPPQILIKNTPVPANPPETFTPAKFASFITQYSTGQVSVEIEWELQKENSKRWNPEIQYTSNYDKQTGVDFAVDTQGVYSEPRPIGTRYLTRNL

SEQ ID NO: 47 - protein, 730 aa, Macaca fascicularis
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEAAKTAPGKKRPVDSPDSTSGIGKKGQQPARKRLNFGQTGDAESVPDPQPIGEPPAAPSGLGSGTMAAGGGAPMADNNEGADGVGNASGNWHCDSTWLGNRVITTSTRTWALPTYNNHLYKQISSSSSGATNDNHYFGYSTPWGYFDFNRFHCHFSPRDWQRLINNNWGFRPKRLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYEFEDVPFHSSYAHSQSLDRLMNPLIDQYLYYMARTQSSTGTSTREPQFHQAGPATMAEQSKNWLPGPCFRQQRISKTTDNNNNSNFAWTGATKYHLNGRNSLTNPGVPMATHKDDESVFFPINGVLVFGKTGASNKTTLENVLMTDEEEIKATNPVATEEYGVVSSNIQSQNSNPTTQTVNNQGALPGMVWQNRDVYLQGPIWAKIPHTDGDFHPSPLMGGFGLKHPPPQILIKNTPVPANPPETFTPAKFASFITQYSTGQVSVEIEWELQKENSKRWNPEIQYTSNYDKQTGVDFAVDTQGVYSEPRPIGTRYLTRNL

SEQ ID NO: 48 - protein, 730 aa, Macaca fascicularis
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEAAKTAPGKKRPVDSPDSTSGIGKKGQQPARKRLNFGQTGDAESVPDPQPIGEPPAAPSGLGSGTMAAGGGAPMADNNEGADGVGNASGNWHCDSTWLGNRVITTSTRTWALPTYNNHLYKQISSGSSGATNDNHYFGYSTPWGYFDFNRFHCHFSPRDWQRLINNNWGFRPKRLRFKLFNIQVKEVTTNDGVTTIANNLTSTVQVFSDSEYQLPYVLGSAHQGCLPPFPADVFMIPQYGYLTLNNGSQSVGRSSFYCLEYFPSQVLRTGNNFEFSYEFEDVPFHSSYAHSQSLDRLMNPLIDQYLYYLARTQSSTGTSTRELQFHQAGPATMAEQSKNWLPGPCFRQQRISKTSDNNNNSNFAWTGATKYHLNGRNSLTNPGVPMATHKDDESVFFPINGVLVFGKTGASNKTTLENVLMTDEEEIKATNPVATEEYGVVSSNIQSQNSNPTTQTVNNQGALPGMVWQNRDVYLQGPIWAKIPHTDGNFHPSPLMGGFGLKHPPPQILIKNTPVPANPPETFTPAKFASFITQYSTGQVSVEIEWELQKENSKRWNPEIQYTSNYDKQTGVDFAVDTQGVYSEPRPIGTRYLTRNL

SEQ ID NO: 49 - protein, 730 aa, Macaca fascicularis
MAADGYLPDWLEDNLSEGIREWWALKPGAPQPKANQQKQDDGRGLVLPGYRYLGPFNGLDKGEPVNEADAAALEHDKAYDQQLKAGDNPYLRYNHADAEFQERLQEDTSFGGNLGRAVFQAKKRILEPLGLVEEAAKTAPGKERPVDSPDSTSGIGKKGQQPARKRLNFGQTGDAESVPDPQPIGEPPAAPSGLGSGTMAAGGGAPMADNNEGADGVGNASGNWHCDSTWLGNRVITTSTRTWALPTYDNHLYKQISSSSSGATNDNHYFGYSTPWGYFDFNRFHCHFSPRDWQRLINNNWGFRPKRLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYEFEDVPFHSSYAHSQSLDRLMNPLIDQYLYYLARTQSSTGTSTRELQFHQAGPATMAEQSKNWLPGPCFRQQRISKTTDNNNNSNFAWTGATKYHLNGRNSLTNPGVPMATHKDDESVFFPINGVLVLGKTGASNKTTLENVLMTDEEEIKATNPVATEEYGVVSSNIQSQNSNPTTQTVNNQGALPGMVWQNRDVYLQGPIWAKIPHTDGNFHPSPLMGGFGLKHPPPQILIKNTPVPANPPETFTPAKFASFITQYSTGQVSVEIEWELQKENSKRWNPEIQYTSNYDKQTGVDFAVDTQGVYSEPRPIGTRYLTRNL

SEQ ID NO: 50 - protein, 730 aa, Macaca fascicularis
MAADGYLPDWLEDNLSEGIREWWALKPGAPRPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEAAKTAPGKKRPVDSPDSTSGIGKKGQQPARKRLNFGQTGDAESVPDPQPIGEPPAAPSGLGSGTMAAGGGAPMADNNEGADGVGNASGNWHCDSTWLGNRVITTSTRTWALPTYNNHLYKQISSSSSGATNDNHYFGYSTPWGYFDFNRFHCHFSPRDWQRLINNNWGFRPKRLRFKLFNIQVKEVTTNDGVTTIANNLTSTVQVFSDSEYQLPYVLGSAHQGCLPPFPADVFMIPQYGYLTLNNGSQSVGRSSFYRLEYFPSQMLRTGNNFEFSYEFEDVPFHSSYAHSQSLDRLMNPLIDQYLYYLARTQSSTGTSTRELQFHQAGPATMAEQSKNWLPGPCFRQQRISKTTDNNNNSNFAWTGATKYHLNGRNSLTNPGVPMATHRDDESVFFPINGVLVFGKTGASNKTTLENVLMTDEEEIKATNPVATEEYGVVSSNIQSQNSNPTTQTVNNQGALPGMVWQNRDVYLQGPIWAKIPHTDGNFHPSPLMGGFGLKHPPPQILIKNTPVPANPPETFTPAKFASFITQYSTGQVSVEIEWELQKENSKRWNPEIQYTSNYDKQTGVDFAVDTQGVYSEPRPIGTRYLTRNL

SEQ ID NO: 51 - protein, 736 aa, Callithrix jacchus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDTESVPDPQPLREPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKPFNIQVKEVTTNEGTKTIANNPTSTVQVFTDSEYQLPYVLGSARQGCLPPFPADVFMVPQYGYLTLNNGSQALGRSSFYCLEYFPSQMLRTGDNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQAANTLAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 52 - protein, 736 aa, Callithrix jacchus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGANTAPGKKRPVEQSPQEPDSSSGIGKTGQQPAKKRLNFGQTGDSESVPDPQPLREPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINSNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 53 - protein, 716 aa, Sus scrofa
MSFVDHPPDWLEEIGEGLKEFLGLEPGPPKPKPNQQKQDNARGLVLPGYNYLGPGNGLDRGEPVNRADEVAREHDISYNEQLQAGDNPYLKYNHADAEFQEKLADDTSFGGNLGKAVFQAKKRVLEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVNNYWGFRPRSLKVKIFNIQVKEVTVQDATTTIANNLTSTVQVFTDDDYQLPYVIGNGTEGCLPAFPPQVFTLPQYGYATLNRNNTDDPTERSSFFCLEYFPSKMLRTGNSFEFTYSFEEVPFHCSFAPSQNLFKLANPLVDQYLYRFVSTDTSGNIQFQKNLKARYANTYKNWFPGPMCRTQGWYTGSGTYNRSGVTNFATSNRMDLEGASYQVNPQPNGMTNTLQDSNKYALENTMIFNSQNAEPGTTSLYQENNLLITSESETQPVNRVAYDTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSFITQYSTGQVTVEMEWELKKEDSKRWNPEIQYTNNYNNPEFVDFAPDTSGEYRTTRAIGTRYLTRPL

SEQ ID NO: 54 - protein, 716 aa, Sus scrofa
MSFVDHPPDWLEEIGEGLKEFLGLEPGPPKPKPNQQKQDNARGLVLPGYNYLGPGNGLDRGEPVNRADEVAREHDISYNEQLQAGDNPYLKYNHADAEFQEKLADDTSFGGNLGKAVFQAKKRALEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVNNYWGFRPRSLKVKIFNIQVKEVTVQDATTTIANNLTSTVQVFTDDDYQLPYVIGNGTEGCLPAFPPQVFTLPQYGYATLNRNNTDDPTERSSFFCLEYFPSKMLRTGNSFEFTYSFEEVPFHCSFAPSQNLFKLANPLVDQYLYRFVGTDTSGNIQFQKNLKARYANTYKNWFPGPMCRTQGWYTGSGTYNRSGVTNFATSNRMDLEGASYQVNPQPNGMTNTLQDSNKYALENTMIFNSQNAEPGTTSLYQENNLLITSESETQPVNRVAYDTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSFITQYSTGQVTVEMEWELKKENSKRWNPEIQYTNNYNNPEFVDFAPDTSGEYRTTRAIGTRYLTRPL

SEQ ID NO: 55 - protein, 716 aa, Sus scrofa
MSFVDHPPDWFEEIGEGLKEFLGLEPGPPKPKPNQQKQDNARGLVLPGYNYLGPGNGLDRGEPANRADEVAREHDISYNEQLQAGDNPYLKYNHADAEFQEKLADDTSFGGNLGKAVFQAKKRVLEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVNNYWGFRPRSLKVKIFNIQVKEVTVQDATTTIANNLTSTVQVFTDDDYQLPYVIGNGTEGCLPAFPPQVFTLPQYGYATLNRNNTDDPTERSSFFCLEYFPSKMLRTGNSFEFTYSFGEVPLHCSFAPSQNLFKLANPLVDQHLYRFVSTDTSGNIQFQKNLKARYANTYKNWFPGPMCRTQGWYTGSGTYNRPGVTNFATSNRMDLEGASYQVNPQPNGMTNTLQDSNKYALENTMIFNSQNAEPGTTSLYQENNLLITSESETQPVNRVAYDTGGQMATNAQSTNLAPTVGTYNHQEMLPGSVWMDRDVYLQGPIWAKIPETGAHFHPSPAMGGFGLKHPPPMMLTKNTPVPSNVTAFSEIPVKSFITQYSTGQVTVEMEWELKKENSKRWNPEIQYTNNYNNPEFVDFAPDTSGEYRTTRAIGTRYLTRPL

SEQ ID NO: 56 - protein, 716 aa, Sus scrofa
MSFVDHPPDWLEEIGEGLKEFLGLEPGPPKPKPNQQKQDNARGLVLPGYNYLGPGNGLDRGEPVNRADEVAREHDISYNEQLQAGDNPYLKYNHADAEFQEKLADDTSFGGNLGKAVFQAKKRVLEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVNNYWGFRPRSLKVKIFNIQVKEVTVQDATTTIANNLTSTVQVFTDDDYQLPYVIGNGTEGCLPAFPPQVFTLPQYGYATLNRNNTDDPTERSSFFCLEYFPSKMLRTGNSFEFTYSFEEVPFHCSFAPSQNLFKLANPLVDQYLYRFVSTDTSGNIQFQKNLKARYANTYKNWFPGPMCRTQGWYTGSGTYNRSGVTNFATSNRMDLEGASYQVNPQPNGMTNTLQDSNKYALENTMIFNSQNAEPGTTSLYQENNLLITSESETQPVNRVAYDTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSFITQYSTGQVTVEMEWELKKENSKRWNPEIQYTNNYNNPEFVDFAPDTSGEYRTTRAIGTRYLTRPL

SEQ ID NO: 57 - protein, 716 aa, Sus scrofa
MSFVDHPPDWLEEIGEGLKEFLGLEPGPPKPKPNQQKQDNARGLVLPGYNYLGPGNGLDRGEPVNRADEVAREHGISYNEQLQAGDDPYLKYNHADAEFQEKLADDTSFGGNLGKAVFQAKKRVLEPFGLVEEPAKTAAKGERIDDHYPKKKKARVEETEAGTGGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVNNYWGFRPRSLKVKIFNIQVKEVTVQDATTTIANNLTSTVQVFTDDDYQLPYVIGNGTEGCLPAFPPQVFTLPQYGYATLNRNNTDDPTERSSFFCLEYFPSKMLRTGNSLEFTYSFEEVPFHCSFAPSQNLFKLANPLVDQYLYRFVSTDTSGNIQFQKNLKARYANTYKNWFPGPMCRTQGWYTGSGTYNRSGVTNFATSNRMDLEGASYQVNPQPNGMTNTLQDSNKYALENTMIFNSQNAEPGTTSLYQENNLLITSESETQPVNRVAYDTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSFITQYSTGQVTVEMEWELKKENSKRWNPEIQYTNNYNNPEFVDFAPDTSGEYRTTRAIGTRYLTRPL

SEQ ID NO: 58 - protein, 716 aa, Sus scrofa
MSFVDHPPDWLEEIGEGLKEFLGLKPGPPKPKPNQQKQDNARGLVLPGYNYLGPGNGLGRGEPVNRADEVAREHDISYNEQLQAGDNPYLKYNHADAEFQEKLADDTSFGGNLGKAVFQAKKRVLEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVNNYWGFRPRSLKVKIFNIQVKEVTVQDATTTIANNLTSTVQVFTDDDYQLPYVIGNGTEGCLPAFPPQVFTLPQYGYATLNRNNTDDPTERSSFFCLEYFPSKMLRTGNSFEFTYSFEEVPFHCSFAPSQNLFKLANPLVDQYLYRFVSTDTSGNIQFQKNLKARYANTYKNWFPGPMCRTQGWYTGSGTYNRSGVTNFATSNRMDLEGASYQANPQPNGMTNTLQDSNKYALENTMIFNSQNAEPGTTSLYQENNLLITSESETQPVNRVAYDTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSLITQYSTGQVTVEMEWELKKENSKRWNPEIQYTNNYNNPEFVDFAPDTSGEYRTTRAIGTRYLTRPL

SEQ ID NO: 59 - protein, 716 aa, Sus scrofa
MSFVDHPPDWLEEIGEGLKEFLGLEPGPPKPKPNQQKQDNARGLVLPGYNYLGPGNGLDRGEPVNRADEVAREHDISYNEQLQAGDNPYLKYNHADAEFQEKLADDTSFGGNLGKAVFQAKKRVLEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVNNYWGFRPRSLKVKIFNIQVKEVTVQDATTTIANNLASTVQVFTDDDYQLPYVIGNGTEGCLPAFPPQVFTLPQYGYATLNRNNTDDPTERSSFFCLEYFPSKMLRTGNSFEFTYSFEEVPFHCSFAPSQNLFKLANPLVDQYLYRFVSTDTSGNIQFQKNLKARYANTYKNWFPGPMCRTQGWYTGSGTYNRSGVTNFATSNRMDLEGASYQVNPQPNGMTNTLQDSNKYALENTMIFNSQNAEPGTTSLYQENNLLITSESETQPVNRVAYDTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSFITQYSTGQVTVEMEWELKKENSKRWNPEIQYTNNYNNPEFVDFAPDTSGEYRTTRAIGTRYLTRPL

SEQ ID NO: 60 - protein, 716 aa, Sus scrofa
MSFVDHPPDWLEEIGEGLKEFLGLEPGPPKPKPNQQKQDNARGLVLPGYNYLGPGNGLDRGEPVNRADEVAREHDISYNEQLQAGDDPYLKYNHADAEFQEKLADDTSFGGNLGKAVFQAKKRVLEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVNNYWGFRPRSLKVKIFNIQVKEVTVQDATTTIANNLTSTVQVFTDDDYQLPYVIGNGTEGCLPAFPPQVFTLPQYGYATLNRNNTDDPTERSSFFCLEYFPSKMLRTGNSFEFTYSFEEVPFHCSFAPSQNLFKLANPLVDQYLYRFVSTDTSGNIQFQKNLKARYANTYKNWFPGPMRRTQGWYTGSGTYNRSGVTNFATSNRMDLEGASYQVNPQPNGMTNTLQDSNKYALENTMIFNSQNAEPGTTSLYQENNLLITSESETQPVNRVAYDTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSFITQYSTGQVTVEMEWELKKENSKRWNPEIQYTNNYNNPEFVDFAPDTSGEYRTTRAIGTRYLTRPL

SEQ ID NO: 61 - protein, 716 aa, Sus scrofa
MSFVDHPPDWLEEIGEGLKEFLGLEPGPPKPKPNQQKQDNARGLVLPGYNYLGPGNGLDRGEPVNRADEVAREHDISYNEQLQAGDNPYLKYNHADAEFQEKLADDTSFGGNLGKAVFQAKKRVLEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWGPRDWQRLVNNYWGFRPRSLKVKIFNIQVKEVTVQDATTTIANNLTSTVQVFTDDDYQLPYVIGNGTEGCLPAFPPQVFTLPQYGYATLNRNNTDDPTERSSFFCLEYFPSKMLRTGNSFEFTYSFEGVPFHCSFAPSQNLFKLANPLVDQYLYRFVSTDTSGNIQFQKNLKARYANTYKNWFPGPMCRTQGWYTGSGTYNRSGVTNFATSNRMDLEGASYQVNPQPNGMTNTLQDSNKYALENTMIFNSQNAEPGTTSLYQENNLLITSESETQPVNRVAYDTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSFITQYSTGQVTVEMEWELKKENSKRWNPEIQYTNNYNNPEFVDFAPDTSGEYRTTRAIGTRYLTRPL

SEQ ID NO: 62 - protein, 716 aa, Sus scrofa
MSFVDHPPDWLEEIGEGLKEFLGLEPGPPKPKPNQQKRDNARGLVLPGYNYLGPGNGLDRGEPVNRVDEVARERDISYNEQLQAGDNPYLKYNHADAEFQEKLADDTSFGGNLGKAVFQAKKRVLEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVNNYWGFRPRSLKVKIFNIQVKEVTVQDATTTIANNLTSTVQVFTDDDYQLPYVIGNGTEGCLPAFPLQVFTLPQYGYATLNRNNTDDPTERSSFFCLEYFPSKMLRTGNSFEFTYSFEEVPFHCSFAPSQNLFKLANPLVDQYLYRFVSTDTSGNIQFQKNLKARYANTYKNWFPGPMCRTQGWYTGSGTYNRSGVTNFATSNRMDLEGASYQVNPQPNGMTNTLQDSNKYALENTMIFNSQNAEPGTTSLYQENNLLITSESETQPVNRVAYDTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSFITQYSTGQVTVEMEWELKKENSKRWNPEIQYTNNYNNPEFVDFAPDTSGEYRTTRAIGTRYLTRPL

SEQ ID NO: 63 - protein, 716 aa, Sus scrofa
MSFVDHPPDWLEEIGEGLKEFLGLEPGPPKPKPNQQKQDNARGLVLPGYNYLGPGNGLDRGEPVNRADEVAREHDISYNEQLQAGDNPYLKYNHADAEFQEKLADDTSFGGNLGKAVFQAKKRVLEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVNNYWGFRPRSLKVKIFNIQVKEVTVQDATTTIANNLTSTVQVFTDDDYQLPYVIGNGTEGCLPAFPPQVFTLPQYGYATLNRNNTDDPTERSSFFCLEYFPSKMLRTGNSFEFTYSFEEVPFHCSFAPSQNLFKLANPLVDQYLYRFVSTDTSGNIQFQKNLKARYANTYKNWFPGPMCRTQGWYTGSGTYNRSGVTNFATSNRMDLEGASYQVNPQPNGMTNTLQDSNKYALENTMIFNSQNAEPGTTSLYQENNLLITSESETQPVNRVAYDTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSFITQYSTGQVTVEMEWELKKENSKRWNPEIQYTNNYNNPEFVDFAPDTSGECRTTRAIGTRYLTRPL

SEQ ID NO: 64 - protein, 716 aa, Sus scrofa
MSFVDHPPDWLEEIGEGLKEFLGLEPGPPKPKPNQQKQDNARGLVLPGYNYLGPGNGLDRGEPVNRADEVAREHDISYNEQLQAGDNPYLKYNHADAEFQEKLADDTSFGGNLGKAVFQAKKRVLEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVDNYWGFRPRSLKVKIFNIQVKEVTVQDATTTIANNLTSTVQVFTDDDYQLPYVIGNGTEGCLPAFPPQVFTLPQYGYATLNRNNTDDPTERSSFFCLEYFPSKMLRTGNSFEFTYSFEEVPFHCSFAPSQNLFKLANPLVDQYLYRFVSTDTSGNIQFQKNLKARYANTYKNWFPGPMCRTQGWYTGSGTYNRSGVTNFATSNRMDLEGASYQVNPQPNGMTNTLQDSNKYALENTMVFNSQNAEPGTTSLYQENNLLITSESETQPVNRVAYNTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSFITQYSTGQVTVEMEWELKKENSKRWNPEIQYTNNYNNPEFVDFAPDTSGEYRTTRAIGTRYLTRPL

SEQ ID NO: 65 - protein, 716 aa, Sus scrofa
MSFVDHPPDWLEEIGEGLKEFLGLEPGPPKPKPNQQKRDNARGLVLPGYNYLGPGNGLGRGEPVNRADEVAREHDISYNEQLQAGDNPYLKYNHADAEFQEKLADDTSFGGNLGKAVFQAKKRVLEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVNNYWGLRPRSLKVKIFNIQVKEVTVQDATTTIANNLTSTVQVFTDDDYQLPYVIGNGTEGCLPAFPPQVFTLPQYGYATLNRNNTDDPTERSSFFCLEYFPSKMLRTGNSFEFTYSFEEVPFHCSFAPSQNLFKLANPLADQYLYRFVSTDTSGNIQFQKNLKARYANTYKNWFPGPMCRTQGWYTGSGTYNRSGVTNFATSNRMDLEGASYQVNPQPNGMTNTLQDSNKYALENTMISNSQNAEPGTTSLYRENNLLITSESETQPVNRVAYDTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSFITQYSTGQVTVEMEWELKKENSKRWNPEIQYTNNYNNPEFVDFAPDTSGEYRTTRAIGTRYLTRPL

SEQ ID NO: 66 - protein, 716 aa, Sus scrofa
MSFVDHPPDWLEEIGEGLKEFLGLEPGPPKPKPNQQKQDNARGLVLPGYNYLGPGNGLDRGEPVNRADEVAREHDISYNEQLQAGDNPYLKYNHADAEFQEKLADDTSFGGNLGKAVFQAKKRVLEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVNNYWGFRPRSLKVKIFNIQVKEVTVQDATTTIANNLTSTVQVFTDDDYQLPYVIGNGTEGCLPAFPPQVFTLPQYGYATLNRNNTDDPTERSSFFCLEYFPSKMLRTGNSFEFTYSFEEVPFHCSFAPSQNLFKLANPLVDQYLYRFVSTDTSGNIQFQKNLKARYANTYKNWFPGPMCRTQGWYTGSGTYNRSGVTNFATSNRMDLEGASYQVNPQPNGMTNTLQDSNKYALENTMIFNSQNAEPGTTSLYQENNLLITSESGTQPVNRVAYDTGGQMATNAQSTNLAPTVGTYNHQEMLPGSVWMDRGVYLQGPIWAKIPETGAHFHPSPAMGGFGLKHPPPMMLIKNTPVPSNVTAFSEIPVKSFVTQYSTGQVTVEMEWELKKENSKRWNPEIQYTNNYNNPEFVDFAPDTSGEYRTTRAIGTRYLTRPL

SEQ ID NO: 67 - protein, 716 aa, Sus scrofa
MSFVDHPPDWLEEIGEGLKEFLGLEPGPPKPKPNQQKQDNARGLVLPGYNYLGPGNGLDRGEPVNRADEVAREHDISYNEQLQAGDNPYLKYNHADAEFQEKLADDTSFGGNLGKAVFQAKKRVLEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNAHAYFGYSTPWGYFDFNRFHSHWSPRDWQRLVNNYWGFRPRSLKVKIFNIQVKEVTVQDATTTIANNLTSTVQVFTDDDYQLPYVIGNGTEGCLPAFPPQVFTLPQYGYATLNRNNTDDPTERSSFFCLEYFPSKMLRTGNSFEFTYSFEEVPFHCSFAPSQNLFKLANPLVDQYLYRFVSTDTSGNIQFQKNLKARYANTYKNWFPGPMCRTQGWYTGSGTYNRSGVTNFATSNRMDLEGASYQVNPQPNGMTNTLQDSNKYALENTMIFNSQNAEPGTTSLYQENNLLITSESETQPVNRVAYDTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSFITQYSTGQVTVEMEWELKKENSKRWNPEIQYTNNYNNPEFVDFAPDTSGEYRTTRAIGTRYLTRPL

SEQ ID NO: 68 - protein, 716 aa, Sus scrofa
MSFVDHPPDWLEEIGEGLKEFLGLEPGPPKPKPNQQKRDNARGLVLPGYNYLGPGNGLDRGEPVNRADEVAREHDISYNEQLQAGDNPYLKYNHADAEFQEKLADDTSFGGNLGKAVFQAKKRVLEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVNNYWGFRPRSLKVKIFNIQVKEVTVQDATTTIANNLTSTVQVFTDDDYQLPYVIGNGTEGCLPAFPPQVFTLPQYGYATLNRNNTDDPTERSSFFCLEYFPSKMLRTGNSFEFTYSFEEVPFHCSFAPSQNLFKLANPLVDQYLYRFVSTDTSGNIQFQKNLKARYANTYKNWFPGPMCRTQGWYTGSGTYNRSGVTNFATSNRMDLEGASYQVNPQPNGMTNTLQDSNKYALENTMIFNSQNAEPGTTSLYQENNLLITSESETQPVNRVAYDTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSFITQYSTGQVTVEMEWELKKENSKRWNPEIQYTNNYNNPEFVGFAPDTSGEYRTTRAIGTRYLTRPL

SEQ ID NO: 69 - protein, 716 aa, Sus scrofa
MSFVDHPPDWLEEIGEGLKEFLGLEPGPPKPKPNQQKQDNARGLVLPGYNYLGPGNGLDRGEPVNRADEVAREHDISYNEQLQAGDNPYLKYNHADAEFQEKLADDTSFGGNLGKAVFQAKKRVLEPFGLVEEPAKTAAKGERIGDHYPKKKKARVEETEAGTSGGQQPQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVNNYWGFRPRSLKVKIFNIQVKEVTVQDATTTIANNLTSTVQVFTDDDYQLPYVIGNGTEGCLPAFPPQVFTLPQYGYATLNRNNTDDPTERSSFFCLEYLPSKMLRTGNSFEFTYSFEEVPFHCSFAPSQNLFKLANPLVDQYLYRFVSTDTSGNIQFQKNLKARYANTYKNWFPGPMCRTQGWYTGSGTYNRSGVTNFATSNRMDLEGASYQVNPQPNGMTNTLQDSNKYALENTMIFNSQNAEPGTTSLYQENNLLITSESETQPVNRVAYNTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSFITQYSTGQVTVEMEWELKKENSKRWNPEIQYTNNYNNPEFVDFAPDTSGEYRTTRAIGTRYLTRPL

SEQ ID NO: 70 - protein, 716 aa, Sus scrofa
MSFVDHPPDWLEEIGEGLKEFLGLKPGPLKPKPNQQKQDNARGLVLPGYNYLGPGNGLDRGEPVNRADEVAREHDISYNEQLQAGDNPYLKYNHADAEFQEKLADDTSFGGNLGKAVFQAKKRVLEPFGLVEEPAKTAAKGERIDDHYPKKKKARVEETEAGTSGGQQLQIPAQPASSLGADTMSAGGGSPLGDNNQGADGVGNASGDWHCDSTWMGDRVITKSTRTWVLPSYNNHLYKEIHSGSVDGSNANAYFGYSTPWGYFDFNRFHSHWSPRDWQRLVNNYWGFRPRSLKVKIFNIQVKEVTVQDATTTIANNLTSTVQVFTDDDYQLPYVIGNGTEGCLPAFPPQVFTLPQYGYATLNRNNTDDPTERSSFFCLEYFPSKMLRTGNSFEFTYSFEEVPFHCSFAPSQNLFKLANPLVDQYLYRFVSTDTPGNIQFQKNLKARYANTYKNWFPGPMCRTQGWYTGSGTYNRSGVTNFATSNRMDLEGASYQANPQPNGMTNTLQDSNKYALENTMIFNSQNAEPGTTSLYQENNLLITSESETQPVNRVAYDTGGQMATNAQSTNLAPTVGTYNHQEMLPGSVWMDRDVYLQGPIWAKIPETGAHFHPSPAMGGFGLKHPPPMMLIKNTPVPSNVTAFSEIPVKSLITQYSTGQVTVEMEWELKKENSKRWNPEIQYTNNYNNPEFVDFAPDTSGEYRTTRAIGTRYLTRPL

SEQ ID NO: 71 - protein, 736 aa, Macaca mulatta
MAADGYLPDWLEDNLSEGIREWWDLKPGAPKPKANQQKQDDGRGLVLPGYKYLGPFNGLDKGEPANAADAAALEHDKAYDQQLKAGDNPYLRYNHADAEFQERLQEDTSFGGNLGRAIFQAKKRVLEPLGLVEEGAKTAPGKKGPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGTGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 72 - protein, 736 aa, Macaca mulatta
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAIFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNPSGNWHCDSTRLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTSNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGTGNDGVDYSQVLITDEEEIKATNPVATEEYGAVAINNQAANTQAQTGLVHNQGVIPGMVWQNRDVYLQGPIWAKIPHTDGNFHPSPLMGGFGLKLPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 73 - protein, 736 aa, Macaca mulatta
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAIFQAKKRVLEPLGLVEEGAKTAPGKKRPVEQSPQEPDSPSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGTGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 74 - protein, 736 aa, Macaca mulatta
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAIFQAKRRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTSNNFQFSYTFEDVPFHSSCAHSQSLDRLMNPLIDQYLYYLVRTQTTGTGGTQTLAFSQAGPGSMANQARNWVPGPCYRQQRVSTTTNQNNNSNFAWTGAAKFKLNGRDSLMNPGVAMASHKDDDDRFFPSSGVLIFGKQGTGNDGVDYSQVLITDEEEIKATNPVATEEYGAVAINNQAANTQAQTGLVHNQGVIPGMVWQNRDVYLQGPIWAKIPHTDGNFHPPPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 75 - protein, 736 aa, Macaca mulatta
MAADGYLPDWLEDNLSEGIREWWDLKPGAPKPKANQQKQDDGRGLVFPGYKYLGPFNGLDKGEPVNAADAAALEHDKAYDQQLKAGDNPYLRYNHADAEFQERLQEDTSFGGNLGRAIFQAKKRVLEPLGLVEEGAKTAPGKKRPVEQSPQEPDSSSGIGKTGRQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTPGGSTNDNTYFGYSAPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGTGNDGVDYSQVLITDEEEIKATNPVATEEYGAVAINNQAANTQAQTGLVHNQGVIPGMVWQNRDVYQQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 76 - protein, 736 aa, Macaca mulatta
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAIFQAKKRVLEPLGLVEEGAKTAPGKKRPVEQSPQEPDSSSGIGKTGQQPAKKRLNSGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAYQGCLPPFPADVFMVPQYGYLTLNNGSQALGRSSFYCLEYFPSQMLRTGNNFQSSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGTGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 77 - protein, 736 aa, Macaca mulatta
MAADGYLPDWLEDNLSEGIREWWDLKPGASKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTVPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAYQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDDDRFFPSSGVLIFGKQGTGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 78 - protein, 736 aa, Macaca mulatta; identical to SEQ ID NO: 77

SEQ ID NO: 79 - protein, 737 aa, Macaca cyclopis
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSSLGLNTMAAGGGAPMADNNEGADGVGSSSGNWHCDSTRLGDRVITTSTRTWALPTYNNHLYKQISNGTSGGSTNDNTYFGYSTPWGYFDFNRFHCHFSPRDWQRLINNNWGFRPKKLSFKLFNIQVKEVTQNEGTKTIANNLTSTIQVFTDSEYQLSYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPNNMSAQAKNWLPGPMYRQQRVSTTLSQNNNSNFAWTGGTKYHLNGRDSLVNPGVAMATNKDDEDRFFPSSGVLMFGKQGAGKDNVDYSSVMLTSEEEIKTTNPVATEQYGVVADNLQQQNTAPIVGAVNSQEALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVDTEGVYSEHRPIGTRYLTRNL

SEQ ID NO: 80 - protein, 737 aa, Macaca cyclopis
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSSLGLNTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKKLSFKLFNIQVKEVTQNEGTKTIANNLTSTIQVFTDSEYQLPYVPGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPNNMSAQAKNWLPGPMYRQQRVSTTLSQNNNSNFAWTGGTKYHLNGRDSLVNPGVAMATNKDDEDRFFPSSGVLMFGKQGAGKDNVDYSSVMLTSEEEIKTTNPVATEQYGVVADNLQQQNTAPIVGAVNSQGALPGMVWQNRDVYPQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 81 - protein, 737 aa, Macaca cyclopis
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPPGLVEEGAKTAPGKKRPVEQSPQEPDSSSGIGKKGQQPAKKRLNFGQTGDSESVPDPQPLGEPPAAPSSLGLNTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKKLSFKLFNIQVKEVTQNEGTKTIANNLTSTIQVFTDSEYQLPYVLGSAHQGCLPPFPADVFMIPQYGYLTLNNGSQAVGRSFFYCLEYFPSQMLRTGNNFSFSYTFEDVPFHSSYAHSQSLDRLMNPLIDQYLYYLSRTQSTGGTAGTQQLLFSQAGPNNMSAQAKNWLPGPMYRQQRVSTTLSQNNNSNFAWTGGTKYHLNGRDSLVNPGVAMATNKDDEDRFFPSSGVLMFGKQGAGKDNVDYSSVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIERELQKENSKRWNPEIQYTSNYYKSTNVDFAVNTEGVYSEPRPIGTRYLTRNL

SEQ ID NO: 82 - protein, 737 aa, Macaca cyclopis
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKERPVEQSPQEPDSSSGIGKKGQQPAKKRLNFGQTGDSESVPDPQPLGEPPAAPSSLGLNTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKKLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPNNMSAQAKNWLPGPMYRQQRVSTTLSQNNNSNFAWTGGTKYHLNGRDSLVNPGVAMATNKDDEDRFFPSSAVLMFGKQGAGKDNVDYSSVMLTSEEEIKTTNPVTTEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTESVYSEPRPIGTRYLTRNL

SEQ ID NO: 83 - protein, 737 aa, Macaca cyclopis
MAADGYLPDWLEDNLSEGIREWWALKPGAPKPKANQQKQDDGRGLVLPGYKYLGPFNGPDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSSLGLNTMAAGGGAPMADNNEGADGVGSSSGNWHCDSTWLGDRVITTSTRTWALPTYNNHLYKQISNGTSGGSTNDNTYFGYSTPWGYFDFNRSHCHFSPRDWQRLINNNWGFRPKKLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPNNMSAQAKNWLPGPMYRQQRVSTTLSQNNNSNFAWTGGTKYHLNGRDSLVNPGVAMATNKDDEDRFFPSSGVLMFGKQGAGKDNVDYSSVMLTSEEEIRTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 84 - protein, 737 aa, Macaca cyclopis
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSSLGLNTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKKLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPNNMSAQAKNWLPGPMYRQQRVSTTLSQNNNSNFAWTGGTKYHLNGRDSLVNPGVAMATNKDDEDRLFPSSGVLMFGKQGAGKDNVDYSSVMLTSEEEVKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 85 - protein, 737 aa, Macaca cyclopis
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKRRVLEPLGLVEEGAKTAPGKKRPVEQSPQEPDSSSGIGKKGQQPAKKRLNFGQTGDSESVPDPQPLGEPPAAPSSLGLNTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKKLSFKLFNIQVKEVTQNEGTKTIANNLTSTIQVFTDSEYQLPYVLGSARQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPNNMSAQAKNWLPGPMYRQQRVSTTLSQNNNSNFAWTGGTKYHLNGRDSLVNPGVAMATNKDDEDRFFPSSGVLMFGKQGAGKDNVDYSSVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVDTEGVYSEPRPIGTRYLTRNL

SEQ ID NO: 86 - protein, 737 aa, Macaca cyclopis
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSSLGLNTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKKLSFKLFDIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPNNMSAQAKNWLPGPMYRQQRVSTTLSQNNNSNFAWTGGTKYHLNGRDSLVNPGVAMATNKDDEDRFFPSSGVLMFGKQGAGKDNVDYSSVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 87 - protein, 737 aa, Macaca cyclopis
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSSLGLNTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKKLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPNNMSAQAKNWLPGPMYRQQRVSTTLSQNNNSNFAWTGGTKYHLNGRDSLVNPGVAMATNKDDEDRFFPSSAVLMFGKQGAGKDNVDYSSVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTESVYSEPRPIGTRYLTRNL

SEQ ID NO: 88 - protein, 737 aa, Macaca cyclopis
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSSLGLNTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKKLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPNNMSAQAKNWLPGPMYRQQRVSTTLSQNNNSNFAWTGGTKYHLNGRDSLVYPGVAMATNKDDEDRFFPSSGVLMFGKQGAGKDNVDYSSVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 89 - protein, 737 aa, Macaca cyclopis
MAADGYLPDWLEDNLSEGIREWWALKPGAPKPKANQQKQDDGRGLVLPGYKYLGPFNGLDKGGPVNAADAAALEHDKAYDQQLQAGDNPYLRYNHADAEFRERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSSLGLNTMAAGGGAPMADNNEGADGVGSSSGNWHCDSTWLGDRVITTSTRTWALPTYNNHLYKQISNGTSGGSTNDSTYFGYSTPWGYFDFNRSHCHFSPRDWQRLINNNWGFRPKKLSFKLFNIQVKEVTQNEGTKTIANNLTSTIQVFTDSEYQLPYVLGSAHQGCLPPFPADVFMIPQYGYLTLNNGGQAVGRSSFYCLEYFPSQMLRTGNNFSFSYIFEDVPFHSSYAHSQSLDRLMNPLIDQYLYYLSRTQSTGGTAGTQQLLFSQAGPNNMSAQAKNWLPGPMYRQQRVSTTLSQNNNSNFAWTGGTKYHLNGRDSLVNPGVAMATNKDDEDRFFPSSGVLMFGKQGAGKDNVDYSSVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELLKESSKRWNPEIQYTSNYYKSTNVDFAVNTEGVYSEPRPIGTRYLTRNL

SEQ ID NO: 90 - protein, 737 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 91 - protein, 737 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNSTSGGSSNDNTYFGYSTPWGYFDFNRFHCHFSPRDWQRLINNNWGFRPKRLNFKLFNIQVKEVTDNNGVKTIANNLTSTIQVFTDSEYQLPYVLGSAHQGCLPPFPADVFMIPQYGYLTLNDGSQAVGRSSFYCLEYFPSQMLRTGNNFEFSYQFEDVPFHSSYAHSQSLDRLMNPLIDQYLYYLSRTINGSGQNQQTLKFSVAGPSNMAVQAKNWLPGPCYRQQRVSTTVTQNNNSEFAWPGATKYHLNGRDSLVNPGVAMASHKEGEDRFFPLSGSLMFGKQGTGRDNVDADKVMLTSEEEIKTTNPVATEQYGVVATNHQSAQAQAQTGWVQNQGILPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSNNVEFAVNTEGTYSEPRPIGTRYLTRNL

SEQ ID NO: 92 - protein, 731 aa, Adeno-Associated Virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEAAKTAPGKKRPVDSPDSTSGIGKKGQQPARKRLNFGQTGDAESVPDPQPIGEPPAAPSGLGSGTMAAGGGAPMADNNEGADGVGNASGNWHCDSTWLGNRVITTSTRTWALPTYNNHLYKQISSSSSGATNDNHYFGYSTPWGYFDFNRFHCHFSPRDWQRLINNNWGFRPKRLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYEFEDVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQNRDVYLQGPIWAKIPHTDGNFHPSPLMGGFGLKHPPPQILIKNTPVPANPPETFTPAKFASFITQYSTGQVSVEIEWELQKENSKRWNPEIQYTSNYDKQTGVDFAVDTQGVYSEPRPIGTRYLTRNL

SEQ ID NO: 93 - protein, 732 aa, Adeno-Associated Virus
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEAAKTAPGKKRPVDSPDSTSGIGKKGQQPARKRLNFGQTGDAESVPDPQPIGEPPAAPSGLGSGTMAAGGGAPMADNNEGADGVGNASGNWHCDSTWLGNRVITTSTRTWALPTYNNHLYKQISNSTSGGSSNDNHYFGYSTPWGYFDFNRFHCHFSPRDWQRLINNNWGFRPKRLRFKLFNIQVKEVTDNNGVKTIANNLTSTVQVFSDSEYQLPYVLGSAHQGCLPPFPADVFMIPQYGYLTLNDGSQAVGRSSFYCLEYFPSQMLRTGNNFEFSYEFEDVPFHSSYAHSQSLDRLMNPLIDQYLYYLARTINGSGQNQQTLKFSVAGPSNMAVQSKNWLPGPCFRQQRVSTTVTQNNNSEFAWPGATKYHLNGRNSLTNPGVPMASHKEGEDRFFPLSGSLVFGKQGTGRDNVDADKVLMTDEEEIKATNPVATEEYGVVATNHQSAQAQAQTGWVQNQGILPGMVWQNRDVYLQGPIWAKIPHTDGNFHPSPLMGGFGLKHPPPQILIKNTPVPANPPETFTPAKFASFITQYSTGQVSVEIEWELQKENSKRWNPEIQYTSNYYKSNNVEFAVNTEGVYSEPRPIGTRYLTRNL

SEQ ID NO: 94 - protein, 736 aa, Adeno-Associated Virus
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISNSTSGGSSNDNTYFGYSTPWGYFDFNRFHCHFSPRDWQRLINNNWGFRPKKLRFKLFNIQVKEVTDNNGVKTIANNLTSTIQVFSDSEYQLPYVLGSAHQGCLPPFPADVFMIPQYGYLTLNDGSQAVGRSSFYCLEYFPSQMLRTGNNFEFSYSFEDVPFHSSYAHSQSLDRLMNPLIDQYLYYLARTINGSGQNQQTLKFSVAGPSNMAVQAKNWLPGPCFRQQRVSTTVTQNNNSEFAWPGATKYHLNGRNSLVNPGVAMASHKEGEDRFFPLSGSLIFGKQGTGRDNVDADKLMTNEEEIRPTNPVATEEYGIVATNHQSAQAQAQTGWVQNQGILPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFYKSNNVEFAVNTEGVYSEPRPIGTRYLTRNL

SEQ ID NO: 95 - protein, 736 aa, Adeno-Associated Virus
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFEKQTGVDFAVDSQGVYSEPRPIGTRYLTRNL

SEQ ID NO: 96 - protein, 736 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISNSTSGGSSNDNHYFGYSTPWGYFDFNRFHCHFSPRDWQRLINNNWGFRPKRLNFKLFNIQVKEVTDNNGVKTIANNLTSTVQVFSDSEYQLPYVLGSAHQGCLPPFPADVFMIPQYGYLTLNDGSQAVGRSSFYCLEYFPSQMLRTGNNFTFSYTFEDVPFHSSYAHSQSLDRLMNPLIDQYLYYLNRTINGSGQNQQTLKFSVAGPSNMAVQPKNWLPGPCYRQQRVSTTVTQNNNSEFAWPGASKYNLNGRESIINPGTAMASHKEGEDRFFPLSGSMIFGKQGTGRDNVDADKVMITDEEEIKATNPVATERFGTVATNHQSAQAQAQTGWVQNQGILPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYYKSNNVEFAVNTEGLYTEPRPIGTRYLTRPL

SEQ ID NO: 97 - protein, 735 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 98 - protein, 724 aa, Adeno-Associated Virus
MSFFDWLGKQYAQGAAEFWDLKSGPPAPKKARKDGSAGFNFPGHKYLGPGNSLDRGDPVDADDAAAQKHDQSYQEQLEAGDNPYLKYNHADREFQEALKDDTSFEGNLARGLFEAKKLVAEPLGLVEPELAPPSGRKRPVQSSQESGYSSSQDKRPNLDVDEEDREFAAAAAETETGSAPPTGNLGPGTMAGGGSAPIDDGSYGADGVGNASGDWHCDSTWLDNCVITRTTRTWNLPTYNNHIYKRLSSQSGASNDNHSYFGFSTPWGYFDFNRFHCHFSPRDWQRLINNNWGLRPKSLRFKIFNIQVKEVTQNDGTTTISNNLTSTVQVFADTEYQLPYVIGSAHEGCLPPFPADVFMLPQYGYCTLNNGSQPTPRSAFYCLEYFPSKMLRTGNSFEFTYNFEKVPFHSMWAHNQSLDRLMNPLIDQYLYYLDVTNTPSGTTTQSRFTYQKGVHTNLPEQERNWLPGPGIRNQRVSKTSADNNNSEYSWQYSNKYVLENGRASKIAPGPAMASHKDDEEKFFPQSGVLIFGKQGSEKTNVDIEKVMITRETEINSTNPLAGGSLGAVSTNLQRGNRQAALDHTNVMGVFPGSVWQDRDIYLQGQIWAKIPHTDGHFHPSPLMGGFGLKNPPPQILIKNTPVPADPPTEFNANKISSFITQYSTGQVTVEMEWELQKETSKRWNPEIQYTSNYNKSVNVHFAPDDVGNYKEFRSIGTRYLTRPL

SEQ ID NO: 99 - protein, 723 aa, Adeno-Associated Virus
MSFFDWLGKQYAQGAAEFWDLKSGPPAPKKARKDGSAGFNFPGHKYLGPGNSLDRGDPVDADDAAAQKHDQSYQEQLEAGDNPYLKYNHADREFQEALKDDTSFEGNLARGLFEAKKLVAEPLGLVEPELAPPSGRKRPVQSSQESGYSSSQDKRPNLDVDEEDREFAAAAAETETGSAPPTGNLGPGTMAGGGSAPIDDGSYGADGVGNASGDWHCDSTWLDNCVITRTTRTWNLPTYNNHIYKRLSSQSGASNDNHSYFGFSTPWGYFDFNRFHCHFSPRDWQRLINNNWGLRPKSLRFKIFNIQVKEVTQNDGTTTISNNLTSTVQVFADTEYQLPYVIGSAHEGCLPPFPADVFMLPQYGYCTLNNGSQPTPRSAFYCLEYFPSKMLRTGNSFEFTYNFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVFPGSVWQDRDIYLQGQIWAKIPHTDGHFHPSPLMGGFGLKNPPPQILIKNTPVPADPPTEFNANKISSFITQYSTGQVTVEMEWELQKETSKRWNPEIQYTSNYNKSVNVHFAPDDVGNYKEFRSIGTRYLTRPL

SEQ ID NO: 100 - protein, 723 aa, Adeno-Associated Virus
MSFFDWLGKQYAQGAAEFWDLKSGPPAPKKARKDGSAGFNFPGHKYLGPGNSLDRGDPVDADDAAAQKHDQSYQEQLEAGDNPYLKYNHADREFQEALKDDTSFEGNLARGLFEAKKLVAEPLGLVEPELAPPSGRKRPVQSSQESGYSSSQDKRPNLDVDEEDREFAAAAAETETGSAPPTGNLGPGTMAGGGSAPIDDGSYGADGVGNASGDWHCDSTWLDNCVITRTTRTWNLPTYNNHIYKQISNSTSGGSSNDNAYFGFSTPWGYFDFNRFHCHFSPRDWQRLINNNWGLRPKSLRFKIFNIQVKEVTDNNGVKIISNNLTSTVQVFADTEYQLPYVIGSAHEGCLPPFPADVFMLPQYGYLTLNDGSQAVGRSSFYCLEYFPSKMLRTGNSFEFTYNFEKVPFHSMWAHNQSLDRLMNPLIDQYLYYLSKTINGSGQNQQTLKFSVAGPSNMAVQGRNWLPGPGIRQQRVSTTVTQNNNSEFAWPGASSWALNGRASKIAPGPAMASHKEGEDRFFPLSGSLIFGKQGTGRDNVDADKVNITRETEINSTNPLAGGSLGQVATNHQSAQAQAQTGWVQNQGVFPGSVWQDRDIYLQGQIWAKIPHTDGHFHPSPLMGGFGLKNPPPQILIKNTPVPADPPTEFNANKISSFITQYSTGQVTVEMEWELQKETSKRWNPEIQYTSNYYKSNNVEFAVNTEGVYKEFRSIGTRYLTRPL

SEQ ID NO: 101 - protein, 723 aa, Adeno-Associated Virus
MSFFDWLGKQYAQGAAEFWDLKSGPPAPKKARKDGSAGFNFPGHKYLGPGNSLDRGDPVDADDAAAQKHDQSYQEQLEAGDNPYLKYNHADREFQEALKDDTSFEGNLARGLFEAKKLVAEPLGLVEPELAPPSGRKRPVQSSQESGYSSSQDKRPNLDVDEEDREFAAAAAETETGSAPPTGNLGPGTMAGGGSAPIDDGSYGADGVGNASGDWHCDSTWLDNCVITRTTRTWNLPTYNNHIYKRLNGTTSGDQSYFGFSTPWGYFDFNRFHCHFSPRDWQRLINNNWGLRPKSLRFKIFNIQVKEVTTQDSTKIISNNLTSTVQVFADTEYQLPYVIGSAHEGCLPPFPADVFMLPQYGYCTRQDGNSNNPTPRSAFYCLEYFPSKMLRTGNSFEFTYNFEKVPFHSMWAHNQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGVFPGSVWQDRDIYLQGQIWAKIPHTDGHFHPSPLMGGFGLKNPPPQILIKNTPVPADPPTEFNANKISSFITQYSTGQVTVEMEWELQKETSKRWNPEIQYSDDSSSTSGSILHFAPDDVGNYKEFRSIGTRYLTRPL

SEQ ID NO: 102 - protein, 723 aa, Adeno-Associated Virus
MSFFDWLGKQYAQGAAEFWDLKSGPPAPKKARKDGSAGFNFPGHKYLGPGNSLDRGDPVDADDAAAQKHDQSYQEQLEAGDNPYLKYNHADREFQEALKDDTSFEGNLARGLFEAKKLVAEPLGLVEPELAPPSGRKRPVQSSQESGYSSSQDKRPNLDVDEEDREFAAAAAETETGSAPPTGNLGPGTMAGGGSAPIDDGSYGADGVGNASGDWHCDSTWLDNCVITRTTRTWNLPTYNNHIYKQISNSTSGGSSNDNAYFGFSTPWGYFDFNRFHCHFSPRDWQRLINNNWGLRPKSLRFKIFNIQVKEVTDNNGVKIISNNLTSTVQVFADTEYQLPYVIGSAHEGCLPPFPADVFMLPQYGYLTLNDGSQAVGRSSFYCLEYFPSKMLRTGNSFEFTYNFEKVPFHSMWAHNQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGVFPGSVWQDRDIYLQGQIWAKIPHTDGHFHPSPLMGGFGLKNPPPQILIKNTPVPADPPTEFNANKISSFITQYSTGQVTVEMEWELQKETSKRWNPEIQYTSNYYKSNNVEFAVNTEGVYKEFRSIGTRYLTRPL

SEQ ID NO: 103 - protein, 724 aa, Adeno-Associated Virus
MSFFDWLGKQYAQGAAEFWDLKSGPPAPKKARKDGSAGFNFPGHKYLGPGNSLDRGDPVDADDAAAQKHDQSYQEQLEAGDNPYLKYNHADREFQEALKDDTSFEGNLARGLFEAKKLVAEPLGLVEPELAPPSGRKRPVQSSQESGYSSSQDKRPNLDVDEEDREFAAAAAETETGSAPPTGNLGPGTMAGGGSAPIDDGSYGADGVGNASGDWHCDSTWLDNCVITRTTRTWNLPTYNNHIYKQISNGTSGGATNDNTYFGFSTPWGYFDFNRFHCHFSPRDWQRLINNNWGLRPKSLRFKIFNIQVKEVTQNEGTKIISNNLTSTVQVFADTEYQLPYVIGSAHEGCLPPFPADVFMLPQYGYLTLNNGSQAVGRSSFYCLEYFPSKMLRTGNSFEFTYNFEKVPFHSMWAHNQSLDRLMNPLIDQYLYYLSRTQTTGGTANTQTLGFSQGGPNTMANQAKNWLPGPGIRQQRVSTTTGQNNNSNFAWTAGTKYHLNGRASKIAPGPAMATHKDDEERFFPSNGILIFGKQNAARDNADYSDVNITRETEINSTNPLAGGSLGIVADNLQQQNTAPQIGTVNSQGVFPGSVWQDRDIYLQGQIWAKIPHTDGHFHPSPLMGGFGLKNPPPQILIKNTPVPADPPTEFNANKISSFITQYSTGQVTVEMEWELQKETSKRWNPEIQYTSNYYKSTSVDFAVNTEGVYKEFRSIGTRYLTRPL

SEQ ID NO: 104 - protein, 724 aa, Adeno-Associated Virus
MSFFDWLGKQYAQGAAEFWDLKSGPPAPKKARKDGSAGFNFPGHKYLGPGNSLDRGDPVDADDAAAQKHDQSYQEQLEAGDNPYLKYNHADREFQEALKDDTSFEGNLARGLFEAKKLVAEPLGLVEPELAPPSGRKRPVQSSQESGYSSSQDKRPNLDVDEEDREFAAAAAETETGSAPPTGNLGPGTMAGGGSAPIDDGSYGADGVGNASGDWHCDSTWLDNCVITRTTRTWNLPTYNNHIYKRLNGTTSGDQSYFGFSTPWGYFDFNRFHCHFSPRDWQRLINNNWGLRPKSLRFKIFNIQVKEVTTQDSTKIISNNLTSTVQVFADTEYQLPYVIGSAHEGCLPPFPADVFMLPQYGYCTRQDGNSNNPTPRSAFYCLEYFPSKMLRTGNSFEFTYNFEKVPFHSMWAHNQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGVFPGSVWQDRDIYLQGQIWAKIPHTDGHFHPSPLMGGFGLKNPPPQILIKNTPVPADPPTEFNANKISSFITQYSTGQVTVEMEWELQKETSKRWNPEIQYSDDSSSTSGSILHFAPDDVGNYKEFRSIGTRYLTRPL

SEQ ID NO: 105 - protein, 724 aa, Adeno-Associated Virus
MSFFDWLGKQYAQGAAEFWDLKSGPPAPKKARKDGSAGFNFPGHKYLGPGNSLDRGDPVDADDAAAQKHDQSYQEQLEAGDNPYLKYNHADREFQEALKDDTSFEGNLARGLFEAKKLVAEPLGLVEPELAPPSGRKRPVQSSQESGYSSSQDKRPNLDVDEEDREFAAAAAETETGSAPPTGNLGPGTMAGGGSAPIDDGSYGADGVGNASGDWHCDSTWLDNCVITRTTRTWNLPTYNNHIYKQISNGTSGGATNDNTYFGFSTPWGYFDFNRFHCHFSPRDWQRLINNNWGLRPKSLRFKIFNIQVKEVTQNEGTKIISNNLTSTVQVFADTEYQLPYVIGSAHEGCLPPFPADVFMLPQYGYLTLNNGSQAVGRSSFYCLEYFPSKMLRTGNSFEFTYNFEKVPFHSMWAHNQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGVFPGSVWQDRDIYLQGQIWAKIPHTDGHFHPSPLMGGFGLKNPPPQILIKNTPVPADPPTEFNANKISSFITQYSTGQVTVEMEWELQKETSKRWNPEIQYTSNYYKSTSVDFAVNTEGVYKEFRSIGTRYLTRPL

SEQ ID NO: 106 - protein, 729 aa, Adeno-Associated Virus
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKQISSQSGASNDNHYFGFSTPWGYFDFNRFHCHFSPRDWQRLINNNWGMRPKAMRVKIFNIQVKEVTQNDGTTTVANNLTSTVQIFADSSYELPYVMDAGQEGSLPPFPNDVFMVPQYGYLTLNNGSQAVGRSSFYCLEYFPSQMLRTGNNFEITYSFEKVPFHSMYAHSQSLDRLMNPLIDQYLYYLSRTNTPSGTTTQSRLQFSQAGASDIRDQSRNWLPGPSIRQQRVSKTSADNNNSEYSWTGATKYHLNGRWSALTPGPPMATHKDDEEKFFPQSGVLIFGKQGSEKTNVDIEKLIFTSEEELAATNATDTDMWGSVSTNLQRGNRQAATADVNTQGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYNKSVNVDFTVDTNGVYTEPRAIGTRYLTHHL

SEQ ID NO: 107 - protein, 729 aa, Adeno-Associated Virus
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 108 - protein, 729 aa, Adeno-Associated Virus
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKQISSQSGASNDNHYFGFSTPWGYFDFNRFHCHFSPRDWQRLINNNWGMRPKAMRVKIFNIQVKEVTQNDGTTTVANNLTSTVQIFADSSYELPYVMDAGQEGSLPPFPNDVFMVPQYGYLTLNNGSQAVGRSSFYCLEYFPSQMLRTGNNFEITYSFEKVPFHSMYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYNKSVNVDFTVDTNGVYTEPRAIGTRYLTHHL

SEQ ID NO: 109 - protein, 731 aa, Adeno-Associated Virus
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKQISNGTSGGATNDNTYFGFSTPWGYFDFNRFHCHFSPRDWQRLINNNWGMRPKAMRVKIFNIQVKEVTQNEGTKTVANNLTSTVQIFADSSYELPYVMDAGQEGSLPPFPNDVFMVPQYGYLTLNNGSQAVGRSSFYCLEYFPSQMLRTGNNFEITYSFEKVPFHSMYAHSQSLDRLMNPLIDQYLYYLSRTQTTGGTANTQTLGFSQGGPNTMANQAKNWLPGPSIRQQRVSTTTGQNNNSNFAWTAGTKYHLNGRWSALTPGPPMATHKDDEERFFPSNGILIFGKQNAARDNADYSDLIFTSEEELAATNATDTDMWGIVADNLQQQNTAPQIGTVNSQGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYYKSTSVDFAVNTEGVYTEPRAIGTRYLTHHL

SEQ ID NO: 110 - protein, 729 aa, Adeno-Associated Virus
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 111 - protein, 731 aa, Adeno-Associated Virus
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKQISNGTSGGATNDNTYFGFSTPWGYFDFNRFHCHFSPRDWQRLINNNWGMRPKAMRVKIFNIQVKEVTQNEGTKTVANNLTSTVQIFADSSYELPYVMDAGQEGSLPPFPNDVFMVPQYGYLTLNNGSQAVGRSSFYCLEYFPSQMLRTGNNFEITYSFEKVPFHSMYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYYKSTSVDFAVNTEGVYTEPRAIGTRYLTHHL

SEQ ID NO: 112 - protein, 730 aa, Adeno-Associated Virus
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKQISNSTSGGSSNDNAYFGFSTPWGYFDFNRFHCHFSPRDWQRLINNNWGMRPKAMRVKIFNIQVKEVTDNNGVKTVANNLTSTVQIFADSSYELPYVMDAGQEGSLPPFPNDVFMVPQYGYLTLNDGSQAVGRSSFYCLEYFPSQMLRTGNNFEITYSFEKVPFHSMYAHSQSLDRLMNPLIDQYLYYLSKTINGSGQNQQTLKFSVAGPSNMAVQGRNWLPGPSIRQQRVSTTVTQNNNSEFAWPGASSWALNGRWSALTPGPPMATHKEGEDRFFPLSGSLIFGKQGTGRDNVDADKLIFTSEEELAATNATDTDMWGQVATNHQSAQAQAQTGWVQNQGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYYKSTSVDFAVNTEGVYTEPRAIGTRYLTHHL

SEQ ID NO: 113 - protein, 728 aa, Adeno-Associated Virus
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 114 - protein, 730 aa, Adeno-Associated Virus
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKQISNSTSGGSSNDNAYFGFSTPWGYFDFNRFHCHFSPRDWQRLINNNWGMRPKAMRVKIFNIQVKEVTDNNGVKTVANNLTSTVQIFADSSYELPYVMDAGQEGSLPPFPNDVFMVPQYGYLTLNDGSQAVGRSSFYCLEYFPSQMLRTGNNFEITYSFEKVPFHSMYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYYKSNNVEFAVNTEGVYTEPRAIGTRYLTHHL

SEQ ID NO: 115 - protein, 730 aa, Adeno-Associated Virus
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLQISNSTSGGSSNDNAYFGFSTPWGYFDFNRFHCHFSPRDWQRLINNHWGLRPKSMQVRIFNIQVKEVTDNNGVKSNNLTSTVQIFADSTYELPYVMDAGQEGSLPPFPNDVFMVPQYGYLTLNDGSQAVGRSSFYCLEYFPSQMLRTGNNFEMVYKFENVPFHSMYAHSQSLDRLMNPLLDQYLYYLSKTINGSGQNQQTLKFSVAGPSNMAVQGRNWLPGPMMRQQRVSTTVTQNNNSEFAWPGASSWALNGRWSNFAPGTAMATHKEGEDRFFPLSGSLIFGKQGTGRDNVDADKLMFTSEDELRATNPRDTDLFGQVATNHQSAQAQAQTGWVQNQGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYYKSNNVEFAVNTEGVYKEPRAIGSRYLTNHL

SEQ ID NO: 116 - protein, 730 aa, Adeno-Associated Virus
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 117 - protein, 730 aa, Adeno-Associated Virus
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLQISNSTSGGSSNDNAYFGFSTPWGYFDFNRFHCHFSPRDWQRLINNHWGLRPKSMQVRIFNIQVKEVTDNNGVKSNNLTSTVQIFADSTYELPYVMDAGQEGSLPPFPNDVFMVPQYGYLTLNDGSQAVGRSSFYCLEYFPSQMLRTGNNFEMVYKFENVPFHSMYAHSQSLDRLMNPLLDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYYKSNNVEFAVNTEGVYKEPRAIGSRYLTNHL

SEQ ID NO: 118 - protein, 731 aa, Adeno-Associated Virus
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLQISNGTSGGATNDNTYFGFSTPWGYFDFNRFHCHFSPRDWQRLINNHWGLRPKSMQVRIFNIQVKEVTQNEGTKSNNLTSTVQIFADSTYELPYVMDAGQEGSLPPFPNDVFMVPQYGYLTLNNGSQAVGRSSFYCLEYFPSQMLRTGNNFEMVYKFENVPFHSMYAHSQSLDRLMNPLLDQYLYYLSRTQTTGGTANTQTLGFSQGGPNTMANQAKNWLPGPMMRQQRVSTTTGQNNNSNFAWTAGTKYHLNGRWSNFAPGTAMATHKDDEERFFPSNGILIFGKQNAARDNADYSDLMFTSEDELRATNPRDTDLFGIVADNLQQQNTAPQIGTVNSQGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYYKSTSVDFAVNTEGVYKEPRAIGSRYLTNHL

SEQ ID NO: 119 - protein, 731 aa, Adeno-Associated Virus
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLRLGSSNASDTFNGFSTPWGYFDFNRFHCHFSPRDWQRLINNHWGLRPKSMQVRIFNIQVKEVTTSNGETTVSNNLTSTVQIFADSTYELPYVMDAGQEGSLPPFPNDVFMVPQYGYCGLVTGGSSQNQTDRNAFYCLEYFPSQMLRTGNNFEMVYKFENVPFHSMYAHSQSLDRLMNPLLDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYGAQDSLLWAPDNAGAYKEPRAIGSRYLTNHL

SEQ ID NO: 120 - protein, 731 aa, Adeno-Associated Virus
MSFVDHPPDWLESIGDGFREFLGLEAGPPKPKANQQKQDNARGLVLPGYKYLGPGNGLDKGDPVNFADEVAREHDLSYQKQLEAGDNPYLKYNHADAEFQEKLASDTSFGGNLGKAVFQAKKRILEPLGLVETPDKTAPAAKKRPLEQSPQEPDSSSGVGKKGKQPARKRLNFDDEPGAGDGPPPEGPSSGAMSTETEMRAAAGGNGGDAGQGAEGVGNASGDWHCDSTWSESHVTTTSTRTWVLPTYNNHLYLQISNGTSGGATNDNTYFGFSTPWGYFDFNRFHCHFSPRDWQRLINNHWGLRPKSMQVRIFNIQVKEVTQNEGTKSNNLTSTVQIFADSTYELPYVMDAGQEGSLPPFPNDVFMVPQYGYLTLNNGSQAVGRSSFYCLEYFPSQMLRTGNNFEMVYKFENVPFHSMYAHSQSLDRLMNPLLDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGVYPGMVWQDRDIYYQGPIWAKIPHTDGHFHPSPLIGGFGLKSPPPQIFIKNTPVPANPATTFSPARINSFITQYSTGQVAVKIEWEIQKERSKRWNPEVQFTSNYYKSTSVDFAVNTEGVYKEPRAIGSRYLTNHL

SEQ ID NO: 121 - protein, 737 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNSTSGGSSNDNTYFGYSTPWGYFDFNRFHCHFSPRDWQRLINNNWGFRPKRLSFKLFNIQVKEVTDNNGVKTIANNLTSTIQVFTDSEYQLPYVLGSAHQGCLPPFPADVFMIPQYGYLTLNDGSQAVGRSSFYCLEYFPSQMLRTGNNFQFTYTFEDVPFHSSYAHSQSLDRLMNPLIDQYLYYLSRTINGSGQNQQTLGFSVAGPSNMAVQGRNWLPGPCYRQQRVSTTVTQNNNSEFAWPGGTKYHLNGRNSLANPGIAMATHKEGEDRFFPLSGILIFGKQGTGRDNVDADKVMLTSEEEIKTTNPVATEEYGIVATNHQSAQAQAQTGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 122 - protein, 737 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNSTSGGSSNDNTYFGYSTPWGYFDFNRFHCHFSPRDWQRLINNNWGFRPKRLSFKLFNIQVKEVTDNNGVKTIANNLTSTIQVFTDSEYQLPYVLGSAHQGCLPPFPADVFMIPQYGYLTLNDGSQAVGRSSFYCLEYFPSQMLRTGNNFQFTYTFEDVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 123 - protein, 743 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGSNTMASGGGAPMADNNEGADGVGNSSGNWHCDSTWLGDRVITTSTRTWALPTYNNHLYKQISNSTSGGSSNDNTYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNDGSQAVGRSSFYCLEYFPSQMLRTGNNFQFSYTFEDVPFHSSYAHSQSLDRLMNPLIDQYLYFLSRTINGSGQNQQTLQFSQAGPSSMANQARNWVPGPCYRQQRVSTTVTQNNNSEFAWPGATKYHLNGRDSLMNPGVAMASHKEGEDRFFPLSGVLIFGKQGTGRDNVDADKVMITNEEEIKTTNPVATEEYGAVATNHQSAQTLAVPFKAQAQTGLVHNQGVLPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSNNVEFAVNTEGVYSEPRPIGTRFLTRNL

SEQ ID NO: 124 - protein, 736 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGSNTMASGGGAPMADNNEGADGVGNSSGNWHCDSTWLGDRVITTSTRTWALPTYNNHLYKQISNSTSGGSSNDNTYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNDGSQAVGRSSFYCLEYFPSQMLRTGNNFQFSYTFEDVPFHSSYAHSQSLDRLMNPLIDQYLYFLSRTINGSGQNQQTLQFSQAGPSSMANQARNWVPGPCYRQQRVSTTVTQNNNSEFAWPGATKYHLNGRDSLMNPGVAMASHKEGEDRFFPLSGVLIFGKQGTGRDNVDADKVMITNEEEIKTTNPVATEEYGAVATNHQSAQAQAQTGLVHNQGVLPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSNNVEFAVNTEGVYSEPRPIGTRFLTRNL

SEQ ID NO: 125 - protein, 743 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGSNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYFLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQTLAVPFKAQAQTGWVQNQGVLPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRFLTRNL

SEQ ID NO: 126 - protein, 736 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGSNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYFLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGVLPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRFLTRNL

SEQ ID NO: 127 - protein, 736 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGSNTMASGGGAPMADNNEGADGVGNSSGNWHCDSTWLGDRVITTSTRTWALPTYNNHLYKQISNSTSGGSSNDNTYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNDGSQAVGRSSFYCLEYFPSQMLRTGNNFQFSYTFEDVPFHSSYAHSQSLDRLMNPLIDQYLYFLSRTINGSGQNQQTLQFSVAGPSNMAVQARNWVPGPCYRQQRVSTTVTQNNNSEFAWPGATKYHLNGRDSLMNPGVAMASHKEGEDRFFPLSGVLIFGKQGTGRDNVDADKVMITNEEEIKTTNPVATEEYGAVATNHQSAQAQAQTGLVHNQGVLPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSNNVEFAVNTEGVYSEPRPIGTRFLTRNL

SEQ ID NO: 128 - protein, 737 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGSNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYFLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGVLPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRFLTRNL

SEQ ID NO: 129 - protein, 736 aa, Adeno-Associated Virus
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNGTSGGSTNDNAYFGYSTPWGYFDFNRFHCHFSPRDWQRLINNNWGFRPKRLNFKLFNIQVKEVTTNEGTKTIANNLTSTVQVFTDSDYQLPYVLGSAHEGCLPPFPADVFMIPQYGYLTLNNGSQAVGRSSFYCLEYFPSQMLRTGNNFQFSYEFENVPFHSSYAHSQSLDRLMNPLIDQYLYFLSRTQTTGTAGTQTLKFSVAGPSNMAVQGRNYIPGPSYRQQRVSTTTNQNNNSNFAWTGASSWALNGRNSLMNPGPAMASHKDDEDRFFPSSGSLIFGKQGAGNDNVDYSQVMITNEEEIKTTNPVATESYGQVATNNQSANTQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSTNVDFAVNTEGVYSEPRPIGTRFLTRNL

SEQ ID NO: 130 - protein, 736 aa, Adeno-Associated Virus
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYFLSRTQTTGTAGTQTLQFSQAGPSSMANQARNWVPGPCYRQQRVSTTTNQNNNSNFAWTGATKYHLNGRDSLMNPGVAMASHKDDEDRFFPSSGVLIFGKQGAGNDNVDYSQVMITNEEEIKTTNPVATEEYGAVATNNQSANTQAQTGLVHNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRFLTRNL

SEQ ID NO: 131 - protein, 737 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTTNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYFLSRTQTTGTAGTQTLGFSQGGPNTMANQAKNWLPGPCYRQQRVSTTTNQNNNSNFAWTGGTKYHLNGRNSLANPGIAMATHKDDEDRFFPSSGILIFGKQGAGNDNVDYSQVMLTSEEEIKTTNPVATEEYGIVATNNQSANTQAQTGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTNVDFAVNTEGVYSEPRPIGTRFLTRNL

SEQ ID NO: 132 - protein, 737 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYFLSRTQTTGTAGTQTLQFSQAGPSSMANQARNWVPGPCYRQQRVSTTTNQNNNSNFAWTGATKYHLNGRDSLMNPGVAMASHKDDEDRFFPSSGVLIFGKQGAGNDNVDYSQVMITNEEEIKTTNPVATEEYGAVATNNQSANTQAQTGLVHNQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRFLTRNL

SEQ ID NO: 133 - protein, 737 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGSNTMASGGGAPMADNNEGADGVGNSSGNWHCDSTWLGDRVITTSTRTWALPTYNNHLYKQISNGTSGGATNDNTYFGYSTPWGYFDFNRFHCHFSPRDWQRLINNNWGFRPKRLNFKLFNIQVKEVTQNEGTKTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYFLSRTQTTGGTANTQTLQFSQAGPSSMANQARNWVPGPCYRQQRVSTTTGQNNNSNFAWTAATKYHLNGRDSLMNPGVAMASHKDDEERFFPSNGVLIFGKQNAARDNADYSDVMITNEEEIKTTNPVATEEYGAVADNLQQQNTAPQIGLVHNQGVLPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTSVDFAVNTEGVYSEPRPIGTRFLTRNL

SEQ ID NO: 134 - protein, 737 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISSASTGASNDNTYFGYSTPWGYFDFNRFHCHFSPRDWQRLINNNWGFRPKRLSFKLFNIQVKEVTTNDGVTTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQNQSGSAQNKDLGFSQGGPNTMANQAKNWLPGPCYRQQRVSKTKTDNNNSNFTWTGATKYHLNGRNSLANPGIAMASHKDDKDKFFPMSGILIFGKESAGASNTALDNVMLTSEEEIKTTNPVATEEYGIVAVNLQSSSTDPATGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYAKSANVDFAVNTEGVYSEPRPIGTRYLTRNL

SEQ ID NO: 135 - protein, 737 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISSASTGASNDNTYFGYSTPWGYFDFNRFHCHFSPRDWQRLINNNWGFRPKRLSFKLFNIQVKEVTTNDGVTTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQNQSGSAQNKDLGFSRGSPAGMSVQAKNWLPGPCYRQQRVSKTKTDNNNSNFTWTGATKYHLNGRNSLANPGIAMASHKDDKDKFFPMSGILIFGKESAGASNTALDNVMLTSEEEIKTTNPVATEEYGIVAVNLQSSSTDPATGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYAKSANVDFAVNTEGVYSEPRPIGTRYLTRNL

SEQ ID NO: 136 - protein, 737 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISSASTGASNDNTYFGYSTPWGYFDFNRFHCHFSPRDWQRLINNNWGFRPKRLSFKLFNIQVKEVTTNDGVTTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYAKSANVDFAVNTEGVYSEPRPIGTRYLTRNL

SEQ ID NO: 137 - protein, 737 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNSTSGGSSNDNTYFGYSTPWGYFDFNRFHCHFSPRDWQRLINNNWGFRPKRLSFKLFNIQVKEVTDNNGVKTIANNLTSTIQVFTDSEYQLPYVLGSAHQGCLPPFPADVFMIPQYGYLTLNDGSQAVGRSSFYCLEYFPSQMLRTGNNFQFTYTFEDVPFHSSYAHSQSLDRLMNPLIDQYLYYLSRTINGSGQNQQTLGFSVAGPANMAVQGRNWLPGPCYRQQRVSTTVTQNNNSEFAWPGGTKYHLNGRNSLANPGIAMATHKEGEDRFFPLSGILIFGKQGTGRDNVDADKVMLTSEEEIKTTNPVATEEYGIVATNHQSAQAQAQTGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 138 - protein, 737 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNSTSGGSSNDNTYFGYSTPWGYFDFNRFHCHFSPRDWQRLINNNWGFRPKRLSFKLFNIQVKEVTDNNGVKTIANNLTSTIQVFTDSEYQLPYVLGSAHQGCLPPFPADVFMIPQYGYLTLNDGSQAVGRSSFYCLEYFPSQMLRTGNNFQFTYTFEDVPFHSSYAHSQSLDRLMNPLIDQYLYYLSRTINGSGQNQQTLGFSVAGPTNMAVQGRNWLPGPCYRQQRVSTTVTQNNNSEFAWPGGTKYHLNGRNSLANPGIAMATHKEGEDRFFPLSGILIFGKQGTGRDNVDADKVMLTSEEEIKTTNPVATEEYGIVATNHQSAQAQAQTGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 139 - protein, 737 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNSTSGGSSNDNTYFGYSTPWGYFDFNRFHCHFSPRDWQRLINNNWGFRPKRLSFKLFNIQVKEVTDNNGVKTIANNLTSTIQVFTDSEYQLPYVLGSAHQGCLPPFPADVFMIPQYGYLTLNDGSQAVGRSSFYCLEYFPSQMLRTGNNFQFTYTFEDVPFHSSYAHSQSLDRLMNPLIDQYLYYLSRTINGSGQNQQTLGFSVAGPSNAAVQGRNWLPGPCYRQQRVSTTVTQNNNSEFAWPGGTKYHLNGRNSLANPGIAMATHKEGEDRFFPLSGILIFGKQGTGRDNVDADKVMLTSEEEIKTTNPVATEEYGIVATNHQSAQAQAQTGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 140 - protein, 737 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNSTSGGSSNDNTYFGYSTPWGYFDFNRFHCHFSPRDWQRLINNNWGFRPKRLSFKLFNIQVKEVTDNNGVKTIANNLTSTIQVFTDSEYQLPYVLGSAHQGCLPPFPADVFMIPQYGYLTLNDGSQAVGRSSFYCLEYFPSQMLRTGNNFQFTYTFEDVPFHSSYAHSQSLDRLMNPLIDQYLYYLSRTINGSGQNQQTLGFSVAGPSNIAVQGRNWLPGPCYRQQRVSTTVTQNNNSEFAWPGGTKYHLNGRNSLANPGIAMATHKEGEDRFFPLSGILIFGKQGTGRDNVDADKVMLTSEEEIKTTNPVATEEYGIVATNHQSAQAQAQTGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 141 - protein, 737 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNSTSGGSSNDNTYFGYSTPWGYFDFNRFHCHFSPRDWQRLINNNWGFRPKRLSFKLFNIQVKEVTDNNGVKTIANNLTSTIQVFTDSEYQLPYVLGSAHQGCLPPFPADVFMIPQYGYLTLNDGSQAVGRSSFYCLEYFPSQMLRTGNNFQFTYTFEDVPFHSSYAHSQSLDRLMNPLIDQYLYYLSRTINGSGQNQQTLGFSVAGPSNKAVQGRNWLPGPCYRQQRVSTTVTQNNNSEFAWPGGTKYHLNGRNSLANPGIAMATHKEGEDRFFPLSGILIFGKQGTGRDNVDADKVMLTSEEEIKTTNPVATEEYGIVATNHQSAQAQAQTGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 142 - protein, 737 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNSTSGGSSNDNTYFGYSTPWGYFDFNRFHCHFSPRDWQRLINNNWGFRPKRLSFKLFNIQVKEVTDNNGVKTIANNLTSTIQVFTDSEYQLPYVLGSAHQGCLPPFPADVFMIPQYGYLTLNDGSQAVGRSSFYCLEYFPSQMLRTGNNFQFTYTFEDVPFHSSYAHSQSLDRLMNPLIDQYLYYLSRTINGSGQNQQTLGFSVAGASNMAVQGRNWLPGPCYRQQRVSTTVTQNNNSEFAWPGGTKYHLNGRNSLANPGIAMATHKEGEDRFFPLSGILIFGKQGTGRDNVDADKVMLTSEEEIKTTNPVATEEYGIVATNHQSAQAQAQTGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSNNVEFAVNTEGVYSEPRPIGTRYLTRNL

SEQ ID NO: 143 - protein, 736 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGSNTMASGGGAPMADNNEGADGVGNSSGNWHCDSTWLGDRVITTSTRTWALPTYNNHLYKQISNSTSGGSSNDNTYFGYSTPWGYFDFNRFHCHFSPRDWQRLINNNWGFRPKRLNFKLFNIQVKEVTDNNGVKTIANNLTSTVQVFTDSEYQLPYVLGSAHQGCLPPFPADVFMIPQYGYLTLNDGSQAVGRSSFYCLEYFPSQMLRTGNNFQFSYTFEDVPFHSSYAHSQSLDRLMNPLIDQYLYFLSRTINGSGQNQQTLQFSQAGPSSMANQARNWVPGPCYRQQRVSTTVTQNNNSEFAWPGATKYHLNGRDSLMNPGVAMASHKEGEDRFFPLSGVLIFGKQGTGRDNVDADKVMITNEEEIKTTNPVATEEYGAVATNHQRGNRQAQTGLVHNQGVLPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSNNVEFAVNTEGVYSEPRPIGTRFLTRNL

SEQ ID NO: 144 - protein, 734 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQIKSGSVDGSNDNTYFGYSTPWGYFDFNRFHCHFSPRDWQRLINNNWGFRPKRLSFKLFNIQVKEVTVQDSTTTIANNLTSTIQVFTDSEYQLPYVLGSAHQGCLPPFPADVFMIPQYGYLTLNRDNTENPTERSSFYCLEYFPSQMLRTGNNFQFTYTFEDVPFHSSYAHSQSLDRLMNPLIDQYLYYLSRTNTGGVQFSQGGPNTMANQAKNWLPGPCYRQQGWNLGSGVNRASVSAFATGTKYHLNGRNSLANPGIAMATNNLQGSNTYALENTLIFNSQPANPGTTATYLEGNMLTSEEEIKTTNPVATEEYGIVATNNQSSTTAPATGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYNDPQFVDFAVNTEGVYSEPRPIGTRYLTRNL

SEQ ID NO: 145 - protein, 733 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGSNTMASGGGAPMADNNEGADGVGNSSGNWHCDSTWLGDRVITTSTRTWALPTYNNHLYKQIKSGSVDGSNDNTYFGYSTPWGYFDFNRFHCHFSPRDWQRLINNNWGFRPKRLNFKLFNIQVKEVTVQDSTTTIANNLTSTVQVFTDSEYQLPYVLGSAHQGCLPPFPADVFMIPQYGYLTLNRDNTENPTERSSFYCLEYFPSQMLRTGNNFQFSYTFEDVPFHSSYAHSQSLDRLMNPLIDQYLYFLSRTNTGGVQFSQAGPSSMANQARNWVPGPCYRQQGWNLGSGVNRASVSAFATATKYHLNGRDSLMNPGVAMASNNLQGSNTYALENTLIFNSQPANPGTTATYLEGNMITNEEEIKTTNPVATEEYGAVATNNQSSTTAPATGLVHNQGVLPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYNDPQFVDFAVNTEGVYSEPRPIGTRFLTRNL

SEQ ID NO: 146 - protein, 737 aa, Adeno-Associated Virus; identical to SEQ ID NO: 134

SEQ ID NO: 147 - protein, 737 aa, Adeno-Associated Virus; identical to SEQ ID NO: 135

SEQ ID NO: 148 - protein, 737 aa, Adeno-Associated Virus; identical to SEQ ID NO: 136

SEQ ID NO: 149 - protein, 737 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISSETAGSTNDNTYFGYSTPWGYFDFNRFHCHFSPRDWQRLINNNWGFRPKRLSFKLFNIQVKEVTTNDGVTTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQSNPGGTAGNRELGFSQGGPSTMAEQAKNWLPGPCYRQQRVSKTLDQNNNSNFAWTGATKYHLNGRNSLANPGIAMATHKDDEDRFFPSSGILIFGKTGATNKTTLENVMLTSEEEIKTTNPVATEEYGIVSSNLQAANTAAQTGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNFEKQTGVDFAVNTEGVYSEPRPIGTRYLTRNL

SEQ ID NO: 150 - protein, 737 aa, Adeno-Associated Virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISSETAGSTNDNTYFGYSTPWGYFDFNRFHCHFSPRDWQRLINNNWGFRPKRLSFKLFNIQVKEVTTNDGVTTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLARTQSNPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNFEKQTGVDFAVNTEGVYSEPRPIGTRYLTRNL

SEQ ID NO: 151 - protein, 737 aa, Adeno-Associated Virus; identical to SEQ ID NO: 133

SEQ ID NO: 152 - protein, 737 aa, Adeno-Associated Virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGSNTMASGGGAPMADNNEGADGVGNSSGNWHCDSTWLGDRVITTSTRTWALPTYNNHLYKQISNGTSGGATNDNTYFGYSTPWGYFDFNRFHCHFSPRDWQRLINNNWGFRPKRLNFKLFNIQVKEVTQNEGTKTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYFLSRTQTTGGTANTQTLQFSQGGPNTMANQARNWVPGPCYRQQRVSTTTGQNNNSNFAWTAATKYHLNGRDSLMNPGVAMASHKDDEERFFPSNGVLIFGKQNAARDNADYSDVMITNEEEIKTTNPVATEEYGAVADNLQQQNTAPQIGLVHNQGVLPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTSVDFAVNTEGVYSEPRPIGTRFLTRNL

SEQ ID NO: 153 - protein, 738 aa, Adeno-Associated Virus
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISNGTSGGSTNDNTYFGYSTPWGYFDFNRFHCHFSPRDWQRLINNNWGFRPKKLRFKLFNIQVKEVTQNEGTKTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTGGTAGTQQLQFYQGGPSTMAEQAKNWLPGPCFRQQRVSTTLSQNNNSNFAWTGATKYHLNGRNSLVNPGVAMATHKDDEERFFPSSGVLIFGKQGAGKDNVDYSSVLMTNEEEIRPTNPVATEEYGIVADNLQQQNAAPIVQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYYKSTNVDFAVDSQGVYSEPRPIGTRYLTRNL

SEQ ID NO: 154 - protein, 738 aa, Adeno-Associated Virus
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISNGTSGGSTNDNTYFGYSTPWGYFDFNRFHCHFSPRDWQRLINNNWGFRPKKLRFKLFNIQVKEVTQNEGTKTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTGGTAGTQQLQFYQAGPNNMSAQAKNWLPGPCFRQQRVSTTLSQNNNSNFAWTGATKYHLNGRNSLVNPGVAMATHKDDEERFFPSSGVLIFGKQGAGKDNVDYSSVLMTNEEEIRPTNPVATEEYGIVADNLQQQNAAPIVQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYYKSTNVDFAVDSQGVYSEPRPIGTRYLTRNL

SEQ ID NO: 155 - protein, 738 aa, Adeno-Associated Virus
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISNGTSGGSTNDNTYFGYSTPWGYFDFNRFHCHFSPRDWQRLINNNWGFRPKKLRFKLFNIQVKEVTQNEGTKTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYYKSTNVDFAVDSQGVYSEPRPIGTRYLTRNL

SEQ ID NO: 156 - protein, 737 aa, Adeno-Associated Virus
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNGTSGGSTNDNAYFGYSTPWGYFDFNRFHCHFSPRDWQRLINNNWGFRPKRLNFKLFNIQVKEVTQNEGTKTIANNLTSTVQVFTDSDYQLPYVLGSAHEGCLPPFPADVFMIPQYGYLTLNNGSQAVGRSSFYCLEYFPSQMLRTGNNFQFSYEFENVPFHSSYAHSQSLDRLMNPLIDQYLYYLSKTISTGGTAGTQQLKFSVAGPSNMAVQGRNYIPGPSYRQQRVSTTLSQNNNSNFAWTGASSWALNGRNSLMNPGPAMATHKDDEERFFPSSGSLIFGKQGAGKDNVDYSSVMITNEEEIKTTNPVATESYGQVADNLQQQNAAPIVGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSTNVDFAVNTEGVYSEPRPIGTRYLTRNL

SEQ ID NO: 157 - protein, 737 aa, Adeno-Associated Virus
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNGTSGGSTNDNAYFGYSTPWGYFDFNRFHCHFSPRDWQRLINNNWGFRPKRLNFKLFNIQVKEVTQNEGTKTIANNLTSTVQVFTDSDYQLPYVLGSAHEGCLPPFPADVFMIPQYGYLTLNNGSQAVGRSSFYCLEYFPSQMLRTGNNFQFSYEFENVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSTNVDFAVNTEGVYSEPRPIGTRYLTRNL

SEQ ID NO: 158 - DNA, 44 bp, Artificial Sequence
  Synthetic primer
gtgcccttttacggctgcgtgaactggaccaatgaaaactttcc

SEQ ID NO: 159 - DNA, 44 bp, Artificial Sequence
  Synthetic primer
ccgacggagtgggcaatgcctcaggaaattggcattgcgattcc

SEQ ID NO: 160 - protein, 7 aa, Artificial Sequence
  Synthetic polypeptide
TLAVPFK

What is claimed:

1. An adeno-associated virus (AAV) comprising, a capsid protein and a transgene, wherein the capsid protein comprises an amino acid sequence that is at least 95% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28; and wherein the transgene comprises a heterologous gene operably linked to a regulatory sequence that controls expression of the heterologous gene in a host cell.

2. The AAV of claim 1, further comprising an AAV inverted terminal repeat.

3. A composition comprising, the AAV of claim 1 and a physiologically compatible carrier.

4. The AAV of claim 1, wherein the capsid protein comprises an amino acid sequence that is at least 96% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

5. The AAV of claim 1, wherein the capsid protein comprises an amino acid sequence that is at least 97% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

6. The AAV of claim 1, wherein the capsid protein comprises an amino acid sequence that is at least 98% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

7. The AAV of claim 1, wherein the capsid protein comprises an amino acid sequence that is at least 99% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

8. The AAV of claim 1, wherein the capsid protein comprises an amino acid sequence that is identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

9. The AAV of claim 1, wherein the heterologous gene encodes a therapeutic protein.

10. An adeno-associated virus (AAV) comprising,
(a) a capsid protein, wherein the capsid protein comprises an amino acid sequence that is at least 95% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28; and (b) a nucleic acid sequence comprising AAV inverted terminal repeats and a transgene, wherein the transgene comprises a heterologous gene operably linked to a regulatory sequence that controls the expression of the heterologous gene in a host cell.

11. The AAV of claim 10, wherein the capsid protein comprises an amino acid sequence that is at least 96% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

12. The AAV of claim 10, wherein the capsid protein comprises an amino acid sequence that is at least 97% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

13. The AAV of claim 10, wherein the capsid protein comprises an amino acid sequence that is at least 98% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

14. The AAV of claim 10, wherein the capsid protein comprises an amino acid sequence that is at least 99% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

15. The AAV of claim 10, wherein the capsid protein comprises an amino acid sequence that is identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

16. The AAV of claim 10, wherein the heterologous gene encodes a therapeutic protein.

17. A composition comprising, the AAV of claim 10, and a physiologically compatible carrier.

18. A vector comprising a nucleic acid sequence encoding an adeno-associated virus (AAV) capsid protein, wherein the capsid protein comprises an amino acid sequence that is at least 95% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28, wherein the nucleic acid sequence is operably linked to a heterologous regulatory sequence that controls the expression of the capsid protein in a host cell.

19. The vector of claim 18, wherein the AAV capsid protein comprises an amino acid sequence that is at least 96% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

20. The vector of claim 18, wherein the AAV capsid comprises an amino acid sequence that is at least 97% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

21. The vector of claim 18, wherein the AAV capsid comprises an amino acid sequence that is at least 98% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

22. The vector of claim 18, wherein the AAV capsid comprises an amino acid sequence that is at least 99% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

23. The vector of claim 18, wherein the AAV capsid comprises an amino acid sequence that is identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

24. The vector of claim 18, wherein the heterologous regulatory sequence comprises a constitutive promoter, an inducible promoter, or tissue-specific promoter.

25. A cultured host cell containing a nucleic acid sequence encoding an AAV capsid protein linked to a heterologous amino acid sequence, wherein the capsid protein comprises an amino acid sequence that is at least 95% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

26. The cultured host cell of claim 25, wherein the AAV capsid protein comprises an amino acid sequence that is at least 96% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

27. The cultured host cell of claim 25, wherein the AAV capsid protein comprises an amino acid sequence that is at least 97% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

28. The cultured host cell of claim 25, wherein the AAV capsid protein comprises an amino acid sequence that is at least 98% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

29. The cultured host cell of claim 25, wherein the AAV capsid protein comprises an amino acid sequence that is at least 99% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

30. The cultured host cell of claim 25, wherein the AAV capsid protein comprises an amino acid sequence that is identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

31. The cultured host cell of claim 25, wherein the cultured host cell further contains a functional AAV rep gene.

32. The cultured host cell of claim 25, wherein the cultured host cell is an insect or mammalian cell.

33. A method for producing an AAV viral particle comprising,
(a) culturing a host cell to produce the AAV viral particle in cell culture, the host cell comprising a nucleic acid sequence encoding an AAV capsid protein, a nucleic acid sequence encoding an AAV rep protein, and a nucleic acid sequence comprising a transgene, wherein the transgene comprises a heterologous gene operably linked to a heterologous regulatory sequence that controls the expression of the heterologous gene in a host cell, and wherein the capsid protein comprises an amino acid sequence that is at least 95% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28; and (b) collecting the AAV viral particle from the cell culture.

34. The method of claim 33, wherein the host cell is an insect cell or a mammalian cell.

35. An AAV viral particle comprising a capsid protein and a transgene produced by a method comprising:
(a) culturing a host cell to produce the AAV viral particle in cell culture, wherein the host cell comprises a nucleic acid sequence encoding an AAV capsid protein, a nucleic acid sequence encoding an AAV rep protein, and a nucleic acid sequence comprising the transgene, wherein the transgene comprises a heterologous gene operably linked to a heterologous regulatory sequence that controls the expression of the heterologous gene in a host cell, and wherein the capsid protein comprises an amino acid sequence that is at least 95% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28; and (b) collecting the AAV viral particle from the cell culture.

36. The AAV viral particle of claim 35, wherein the AAV capsid protein comprises an amino acid sequence that is at least 98% identical to: (i) the VP1 capsid protein of SEQ ID NO: 28; (ii) the VP2 capsid protein of amino acids 138-739 of SEQ ID NO: 28; or (iii) the VP3 capsid protein of amino acids 206-739 of SEQ ID NO: 28.

37. A host cell comprising, the vector of claim 18.

* * * * *